United States Patent 11,141,474 (ARTIFICIAL NUCLEIC ACID MOLECULES ENCODING A NOROVIRUS ANTIGEN AND USES THEREOF) - sequence listing, part 7

SEQ ID NO: 14958 - RNA, 1608 nt, Artificial Sequence
  derived and/or modified sequence opt2 from capsid_protein__Norovirus__AEP16505
augaagauggccuccuccgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagguccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuucccccucgagaaccucucccccggccagaucaccauguucccccacgucaucaucgacguccgcacccucgagcccguccuccucccccuccccgacguccgcaacaacuucuuccacuacaaccagcagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccguccccaucgacgagcucuacaccucccccaacgagggcgucgucguccagccccagaacggccgcuccacccucgacggcgagcuccucggcaccacccagcucguccccuccaacaucugcgcccuccgcggccgcaucaacgcccagguccccgacgaccaccaccaguggaaccuccaggucaccaacgccaacggcaccuccuucgaccccaccgaggacguccccgccccccucggcacccccgacuuccucgccaacaucuacggcgucaccucccagcgcaaccccgacaacaccugccgcgcccacgacggcguccucgccaccuggucccccaaguucacccccaagcucggcuccgucguccucggcaccugggaggaguccgaccucgaccucaaccagcccacccgcuucacccccgucggccucuacgacaccaaccacuucgaccaguggauccuccccaacuacuccggccgccucacccucaacaugaaccucgcccccuccgucgccccccucuuccccggcgagcagauccucuucuuccgcucccacaucccccucaagggcggcaccuccaacggcgccaucgacugccuccucccccaggaguggauccagcacuucuaccaggaguccgcccccucccccaccgacgucgcccucauccgcuaccccaaccccgacaccggccgcguccucuucgaggccaagcuccuccgccccggcuucaucaccgucgccaacuucggcuucaagcccaucgucgucccccccaagggcuacuuccgcuucgacuccugggucaaccaguucuacucccucgcccccaugggcaccggcaacggccgccgccgcguccaguga

SEQ ID NO: 14959 - RNA, 1632 nt, Artificial Sequence
  derived and/or modified sequence opt2 from capsid_protein__Norovirus__AEY77318
augaugauggccuccaaggacgcccccaccaacauggacggcaccuccggcgccggccagcucguccccgaggucuccaccgccgagcccaucuccauggagcccgucgccggcgccgccaccgccgccgccaccgccggccaggucaacaugaucgaccccuggaucauguccaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcgucccccccggcuucgccgcccagaacgucuccaucgcccaggccaccauguucccccacgucaucgccgacguccgcguccucgagcccaucgaggucccccucgaggacguccgcaacguccucuuccacaacaacgacuccacccccaccaugcgccucaucugcaugcucuacaccccccuccgcgccuccggcuccuccuccggcaccgaccccuucgucaucgccggccgcguccucaccugccccucccccgacuucaacuuccucuuccucgucccccccaacgucgagcagaagaccaagcccuucuccguccccaaccucccccucaacguccucuccaacucccgcguccccucccucaucaaguccaugauggucucccaggaccacggccagaugguccaguuccagaacggccgcgucacccucgacggccagcuccagggcaccacccccaccuccgccucccagcucugcaagauccgcggcaccgucuaccacgccaccggcggccagggccucaaccucaccgagaucgacggcacccccuaccacgccuucgagucccccgcccccaucggcuuccccgaccucggcgagugcgacuggcacaucaacgccucccccgccaacgccuucaccgacggcuccaucauccaccgcaucgacgucgcccaggacuccaccuucgccccccaccucggcaccauccacuacaccaacgccgacuacaacgccaacgucggccucaucugcucccucgaguggcucuccccccccuccggcggcgcccccaaggucaaccccugggccaucccccgcuacggcuccacccucaccgaggccgcccagcucgccccccccaucuacccccccggcuucggcgaggccaucgucuucuucauguccgacuuccccaucgccaacggcuccgacggccucuccguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucaucuccugggucucccgcuucuaccagcucaagcccgucggcaccaccggccccguccgccgccucggcauccgccgcuccuga

SEQ ID NO: 14960 - RNA, 1626 nt, Artificial Sequence
  derived and/or modified sequence opt2 from capsid_protein__Norovirus__AEY83583
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgcccccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccaggucgacggcacccuccucggcaccacccccgucuccggcuccugggucuccugcuucgccgccgaggccgccuacgaguuccaggccggcaccggcgaggucgucaccuucaccaugaucgagcaggacggcuccgccuacguccccggcgaccgcgccgccccccucggcuaccccgacuucuccggccagcucgagaucgagguccagaccgagaccaccaagaccggcgacaagcuccgcgucaccaccuucgagaugauccucggccccaccaccaacgucgaccaggcccccuaccagggccgcgccuacgccucccucaccgccgccgccucccucgaccucgucgacggccgcguccgcgccgucccccgcuccaucuacuccuuccaggacgagcuccccgaguacaacgacggcguccucgucccccucgcccccccccucggccccuuccuccccggcgagguccuccuccgcuuccgcaccuacaugcgccagcucgacaccgccgacgccgccgcccagcccaucgacugcgcccucccccaggaguucaucuccugguucgccuccaacaacuucaccguccaguccgacgcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgucaccggccgcacccucaagcaguga

SEQ ID NO: 14961 - RNA, 1629 nt, Artificial Sequence
  derived and/or modified sequence opt2 from capsid_protein__Norovirus__AFB18010
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcaccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguucaagaccaagcccuucacccuccccauccucacccucggcgagauguccaacucccgcuuccccguccccaucgaccagauguacaccucccccaacgagaucaucuccguccagugccagaacggccgcugcacccucgacggcgagcuccagggcaccacccagcuccaggucuccggcaucugcgccuucaagggccaggucaccgcccaccuccaggacaacgagcaccucuacaacgucaccaucaccaaccucaacggcucccccuucgaccccuccgaggacauccccgccccccucggcguccccgacuucgagggccgcgucuucggcgucaucucccagcgcgacaacuacaacuccggcggccagaaccagcccgccaaccgcucccacgacgccgucguccccaccuacaccgcccaguacacccccaagcucggccagauccagaucggcaccuggcagaccgacgacaucaccgucgaccagcccgccaaguucacccccgucggccucuccgacaccgaccacuccaaccagugggucgucccccgcuacgccggcgcccucaaccucaacaccaaccucgcccccuccgucgcccccgucuuccccggcgagcgccuccucuucuuccgcuccuacaucccccucaagggcggcuucggcaaccccgccaucgacugccucgucccccaggaguggauccagcacuucuaccaggaggccgcccccucccucuccgaggucgcccucgcccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 14962 - RNA, 1623 nt, Artificial Sequence
  derived and/or modified sequence opt2 from capsid_protein__Norovirus__AFB18013
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14963 - RNA, 1743 nt, Artificial Sequence
  derived and/or modified sequence opt2 from capsid_protein__Norovirus__AFJ05624
augaagauggccuccaacgacgccaccgcccccucccaggacggcgccgccaaccucguccccgagucccagcacgagguccucgcccucgagcccgucgccggcgccgcccucgccgcccccgucgccggccaguucaacgccaucgaccccuggaucaagcagaacuucguccaggcccccgccggcgaguucaccgucuccccccgcaacgcccccggcgagauccucauggaccucgagcucggccccgagcucaaccccuuccucgcccaccucgcccagauguacaacgccuacgccggcggcauggagguccagaucauccucgccggcaacgccuucaccgccggcaagaucaucgucugcgccgucccccccaacuucccccccgaccgccucuccgccucccaggccaccaacuucccccacgucaucauggacguccgcacccucgagcccgucauccucccccuccccgacguccgcgccggcuucuuccacuacaaccagcuccgcgagccccgcaugcgccucauggcccuccucuacaccccccuccgcgccaacggcaccggcgacgacgccuucaccgucuccugccgcguccucacccgccccaugcaggacuucgaguucauguuccucgucccccccaccgucgagucccgcgucacccccuucuccguccccaccuaccccgucgucgagaugaccaacucccgcuggcccgcccgcaucuccggcaugcacgucaacgccaaccagacccucgccguccaguuccagaacggccgcugcacccucgacggccagcucaugggcaccacccagcucugcgccgccgacgucugccgcaugcgcggccgcuacaccuccacccgcgccgaccucgccggcgucgaccacaccgaccagggccccucccucggcaccggccccuccgacgacuccgucuccguccccgaggcccgcgcccagacccgcaccggcgucuccgcccaccuccagcucgaggagcucaacggccagcccuacgaggucuacggcgagcagcccgccccccucggcacccccgacuuccgcugccgccucaugggcgagcucguccgccuccccuccaccucccccgccgcccagucccgcuuccgcgacgccuucuucgacaccuacggcgcccucuucgcccccgccgucggcuccaccaccuucaccgucaacaacuccuccaccuccgacuucgccaacggccagcccuucgaguuccuccccaucggcgucgagaucggcaacuccgcccaguacgacgaguucgcccuccccuccuacaacggcgccaucggcgagaaccgccaccucgcccccgucgccgcccccggcuuccccggcgagaacaucgucuucuucuccuccaaccuccccgucugggacuccaccuccgcccagaacaaccgccgcaucuccugccuccuccccaacgaguucguccagcacuucuacgaccuccaggcccccucccaguccgacgucgcccuccuccgcuacguccaccccgaguccggccgcguccucuucgagugcaagcucuaccgcgacggcuuccucaccgucaacggcgccucccucgccgaguuccccgucaacggcuacuuccgcuucgacuccugggucaaccaguucuucacccucucccccgucggcaccggcuccggccgccgcggccgcucccgcaacgcccaguga

SEQ ID NO: 14964 - RNA, 1746 nt, Artificial Sequence
  derived and/or modified sequence opt2 from capsid_protein__Norovirus__AFJ05628
augaagauggccuccaacgacgccgccucccccuccuccgacggcgccgccaaccucguccccgagaucaacaacgaggucauggcccucgagcccgucgccggcgcccagcucgccgcccccgucgccggccaguucaacgccaucgaccccuggauccgccagaacuucguccaggcccccgagggcgaguucaccgucuccccccgcaacgcccccggcgagauccuccucaaccucgagcucggcccccaccucaaccccuuccuccagcaccucgcccagauguacaacgccuacgccggcggcauggagguccaggucguccucgccggcaacgccuucaccgccggcaagaucaucuucgccgccguccccccccacuucccccccgagcgccucuccgccgcccaggccacccaguucccccacgucaucgucgacguccgccagcucgagcccaucauccucccccuccccgacguccgccacaaccucuuccacuucaaccagcagaacgacgagcgcaugcaccucgucgccuuccucuacaccccccuccgcgccaacuccggcuccggcgacgacgucuucaccgucuccugccgcguccucacccgccccucccaggacuucgaguucauguuccucgucccccccaccgucgagaagaagaccgucgccuucucccucccccagcucgccaucggcgagauguccaacucccgcuggcccgcccgcaucaccggccucgucgucgacccccgccucccccagguccuccacauccagaacggccgcugcacccucgacggcacccucaugggcaccacccagcucaaccccaacgacaucugccgcauccgcggcuacuucuccuccucccgccccgagcuccucugcgagaacgaggaguccgccaccgaccccaugcccaccgagaccgacaccgacaaccagccccccgagguccgcgcccaggcccgcgccacccagcgcugguucgccgucaccgagcucaacggccaggucuacgaccccuucggcgaccagcccgccccccucggcguccccgacuucaaggcccgcauccucggcgcccucaugcgccuccccggcaccaaccccaccuccaacucccgcuucgaggacgccugggucgagaccaacaaccagaccaccuacgcccccgccgccggcgucgucgccaucaccaccaacgacaacuccuccuccaacuacgccaacgaccagaccugcgaguucgucccccucggcaucgagaucaccgacuccgcccccuaccacgaguucgaccuccccuccuacggcggcgccgccuccuccggcaaccgcaaccucgcccccaccgucgcccccaccuuccccggcgaggccauccuccucuucggcuccaacaugcccgucuacaaccgcaacaccggcaccuccaacaaggacauccgcugccuccuccccaacgaguacguccagcaccucuacgacacccaggcccccucccucuccgacgucgcccucguccgcuacgucaaccgcgacaccggccgcguccucuucgaggccaagcuccaccgcgacggcuucaugaccgucaacgccuccuccaccaccguccuccccgucgacggcuacuuccgcuucgacuccugggucaaccaguucuacgcccucucccccgucggcaacgccuccggccgccgcggccgcucccgccagaccaacuga

SEQ ID NO: 14965 - RNA, 1623 nt, Artificial Sequence
  derived and/or modified sequence opt2 from capsid_protein__Norovirus__AFJ24945
augaagauggccuccaacgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14966 - RNA, 1638 nt, Artificial Sequence
  derived and/or modified sequence opt2 from capsid_protein__Norovirus__AFK75851
augaugauggccuccaaggacgccccccccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucauccgcuccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucgacaccggcgacgucaucaagcagaucaacgucaagcaggaggccgccuucgccccccaccucggcaccauccaggccgacggccucuccgacgucuccgucaacaccaacaugaucgccaagcucggcugggucucccccgucuccgacggccaccgcggcuccgucgaccccugggucaucccccgcuacggcuccacccucaccgaggccgcccagcucgccccccccaucuacccccccggcuucggcgaggccaucgucuucuucauguccgacuuccccaucgcccacggcgccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgagggcuucaugaccugcguccccaacuccuccggcaccggcccccagacccuccccaucaacggcgucuucgccuucgucuccugggucucccgcuucuaccagcucaagcccgucggcaccgccggccccgcccgccgccucggcauccgccgcuccuga

SEQ ID NO: 14967 - RNA, 1635 nt, Artificial Sequence
  derived and/or modified sequence opt2 from capsid_protein__Norovirus__AFK75852
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgccggcuuccccgaccucggcuccugcgacuggcacaucgagauguccaagauccccaacuccuccacccaguccaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucggcguccgccgcuga

SEQ ID NO: 14968 - RNA, 1641 nt, Artificial Sequence
  derived and/or modified sequence opt2 from capsid_protein__Norovirus__AFK75853
augaugauggccuccaaggacgccucccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcaacuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcggccgccucggcguccgccgcaucuga

SEQ ID NO: 14969 - RNA, 1647 nt, Artificial Sequence
  derived and/or modified sequence opt2 from capsid_protein__Norovirus__AFK75854
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaccuucuuccacuacaaccaggacuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcucuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaccccccgccucuucaaccaccgcuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaccaccgaguccgacgacuucgacaccaaccaguccaccaaguucacccccgucggcaucggcgucgacaacgaggccgaguuccagcaguggucccuccccaacuacuccggccaguucacccacaacaugaaccucgcccccgccgucgcccccaacuuccccggcgagcagcuccucuucuuccgcucccagcuccccuccuccggcggcugguccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14970 - RNA, 1671 nt, Artificial Sequence
  derived and/or modified sequence opt2 from capsid_protein__Norovirus__AFN61315
augaagauggccuccuccgacgccgcccccuccgccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccuccgaggccgacgagcgcgccgucggcuccuucgacgucuggauccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcaccggccacaucuccgccaacaaguacugggaguuccgcuccuucggcgucgagggcgagcgccacaccgacguccaguaccaggaguacgagcuccccgacuacuccggccaggucgccuccaaccacaaccucgccccccccgucgccccccgcaugcccggcgagucccuccuccucuuccaguccaacaugcccgucugggacgacggccgcggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccgccuccggccuccucgacuucccccucgacggcuucuuccgcuucgacuccugggucuccuccuucuacauccucucccccgucggcuccggccagggccgccgcggccgcguccgcuuccaguga

SEQ ID NO: 14971 - RNA, 1623 nt, Artificial Sequence
  derived and/or modified sequence opt2 from capsid_protein__Norovirus__AFQ00511
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcguccucuga

SEQ ID NO: 14972 - RNA, 1623 nt, Artificial Sequence; identical to SEQ ID NO: 13851
  derived and/or modified sequence opt2 from capsid_protein__Norovirus__AFQ00512

SEQ ID NO: 14973 - RNA, 1623 nt, Artificial Sequence
  derived and/or modified sequence opt2 from capsid_protein__Norovirus__AFQ00513
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14974 - RNA, 1623 nt, Artificial Sequence
  derived and/or modified sequence opt2 from capsid_protein__Norovirus__AFQ00516
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14975 - RNA, 1623 nt, Artificial Sequence; identical to SEQ ID NO: 13851
  derived and/or modified sequence opt2 from capsid_protein__Norovirus__AFQ00517

SEQ ID NO: 14976 - RNA, 1623 nt, Artificial Sequence; identical to SEQ ID NO: 14516
  derived and/or modified sequence opt2 from capsid_protein__Norovirus__AFQ00518

SEQ ID NO: 14977 - RNA, 1623 nt, Artificial Sequence
  derived and/or modified sequence opt2 from capsid_protein__Norovirus__AFQ00519
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgcccccuucacccccaagaugggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14978 - RNA, 1623 nt, Artificial Sequence
  derived and/or modified sequence opt2 from capsid_protein__Norovirus__AFQ00520
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14979 - RNA, 1623 nt, Artificial Sequence
  derived and/or modified sequence opt2 from capsid_protein__Norovirus__AFQ00521
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcguccucuga

SEQ ID NO: 14980 - RNA, 1623 nt, Artificial Sequence
  derived and/or modified sequence opt2 from capsid_protein__Norovirus__AFQ00522
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14981 - RNA, 1623 nt, Artificial Sequence; identical to SEQ ID NO: 14980
  derived and/or modified sequence opt2 from capsid_protein__Norovirus__AFQ00523

SEQ ID NO: 14982 - RNA, 1623 nt, Artificial Sequence; identical to SEQ ID NO: 14516
  derived and/or modified sequence opt2 from capsid_protein__Norovirus__AFQ00524

SEQ ID NO: 14983 - RNA, 1623 nt, Artificial Sequence; identical to SEQ ID NO: 14516
  derived and/or modified sequence opt2 from capsid_protein__Norovirus__AFQ00525

SEQ ID NO: 14984 - RNA, 1623 nt, Artificial Sequence
  derived and/or modified sequence opt2 from capsid_protein__Norovirus__AFQ00526
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacgccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuaccucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14985 - RNA, 1623 nt, Artificial Sequence; identical to SEQ ID NO: 14516
  derived and/or modified sequence opt2 from capsid_protein__Norovirus__AFQ00527

SEQ ID NO: 14986 - RNA, 1623 nt, Artificial Sequence
  derived and/or modified sequence opt2 from capsid_protein__Norovirus__AFQ00528
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacgcccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14987 - RNA, 1644 nt, Artificial Sequence
  derived and/or modified sequence opt2 from capsid_protein__Norovirus__AGC66782
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaucggccgcugcacccucgacggcucccuccagggcaccacccagcucguccccacccagaucugcuccuucggcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcggcuccgucggcgccacccgcgcccacgagguccacaucgacaccaccaacccccgcuacacccccaagcucggcuccgcccucauguacuccgaguccgacgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacauccucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 14988 - RNA, 1623 nt, Artificial Sequence
  derived and/or modified sequence opt2 from capsid_protein__Norovirus__AGC66784
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccuccuccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaccugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucaacaccgacaccgagaacgacuucgagacccaccagaacaccaaguucacccccgucggcgucauccaggacggcggcaccacccaccgcaacgagccccagcaguggguccuccccuccuacuccggccgcaacauccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14989 - RNA, 1647 nt, Artificial Sequence
  derived and/or modified sequence opt2 from capsid_protein__Norovirus__AGC66785
augaagauggccuccaacgacgccacccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcaugcucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccggcgacuucgaccagaaccagcccacccgcuucacccccgucggcaucggcgucgaccgcgaggccgacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacaucaaccccgacaccggccgcguccucuucgaggccaagcuccacaagcucggcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 14990 - RNA, 1644 nt, Artificial Sequence
  derived and/or modified sequence opt2 from capsid_protein__Norovirus__AGC66786
augaagauggccuccaacgacgccgcccccuccaacgacggcgccgccaaccucguccccgaggccgacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccggccucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccaguccggccgcugcacccucgacggcacccuccagggcaccacccagcucguccccacccagaucugcuccuuccgcggcacccucaucucccagaccucccgcuccgccgacuccaccgacuccgccccccgcguccgcaaccaccccccccacguccagcucaagaaccucgacggcacccccuacgaccccaccgacgagguccccgccguccucggcgccaucgacuucaagggcaccgucuucggcgucgccucccagcgcaacaccaccggcggcuccgucggcgccacccgcgcccacgagguccacaucgacaccaccaacccccgcuacacccccaagcucggcuccguccucauguacuccgaguccgacgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 14991 - RNA, 1623 nt, Artificial Sequence
  derived and/or modified sequence opt2 from capsid_protein__Norovirus__AGC66788
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcggcaccacccaccgcaacgagccccagcaguggguccuccccaacuacuccggcuccgacguccccaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14992 - RNA, 1629 nt, Artificial Sequence
  derived and/or modified sequence opt2 from capsid_protein__Norovirus__AGL96587
augaagauggccuccaacgacgccgcccccuccaacgacggcgccgccucccucguccccgagggcaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucccccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacguccucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaccaacgucguccagugccagaacggccgcugcacccucgacggcgagcuccagggcaccacccagcuccucuccuccgccgucugcuccuaccgcggccgcaccgucgccaacaacggcgacaacugggaccagaaccuccuccagcucaccuaccccaacggcgccuccuacgaccccaccgacgagguccccgccccccucggcacccaggacuucuccggcaugcucuacggcguccucacccaggacaacgucaacgucuccaccggcgaggccaagaacgccaagggcaucuacaucuccaccaccuccggcaaguucacccccaagaucggcuccaucggccuccacuccaucaccgagcacguccaccccaaccagcagucccgcuucacccccgucggcgucgccgucaacgagaacacccccuuccagcaguggguccucccccacuacgccggcuccacccgcucccacaccaaccucggcaccgcccucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcauccaguga

SEQ ID NO: 14993 - RNA, 1623 nt, Artificial Sequence
  derived and/or modified sequence opt2 from capsid_protein__Norovirus__AGQ57036
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucgucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgagaugauguacaccgcccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaagaacgagcagaaccccgccacccgcgcccacgaggccgacaucaacaccggcggcgaccaguacgcccccaagcucgcccaggucaaguucuucuccgagucccaggacuucgagguccaccagcccaccgucuucacccccgucggcgucgccggcgacgccucccaccccuuccgccaguggguccucccccgcuacggcggccaccucaccaacaacacccaccucgcccccgccgucgccccccucuuccccggcgagcagauccucuucuuccgcucccagauccccuccuccggcggccacgagcucggcuacauggacugccucgucccccaggaguggguccagcacuucuaccaggaggccgccaccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcauccaguga

SEQ ID NO: 14994 - RNA, 1623 nt, Artificial Sequence
  derived and/or modified sequence opt2 from capsid_protein__Norovirus__AGT95926
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14995 - RNA, 1623 nt, Artificial Sequence
  derived and/or modified sequence opt2 from capsid_protein__Norovirus__AGT95927
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggucaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14996 - RNA, 1623 nt, Artificial Sequence
  derived and/or modified sequence opt2 from capsid_protein__Norovirus__AGT95928
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucuccaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14997 - RNA, 1623 nt, Artificial Sequence
  derived and/or modified sequence opt2 from capsid_protein__Norovirus__AGT95929
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcgucgucuga

SEQ ID NO: 14998 - RNA, 1623 nt, Artificial Sequence
  derived and/or modified sequence opt2 from capsid_protein__Norovirus__AGT95930
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccaccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14999 - RNA, 1623 nt, Artificial Sequence
  derived and/or modified sequence opt2 from capsid_protein__Norovirus__AGT95931
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 15000 - RNA, 1623 nt, Artificial Sequence
  derived and/or modified sequence opt2 from capsid_protein__Norovirus__AHC12655
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuccaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccaucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 15001 - RNA, 1623 nt, Artificial Sequence
  derived and/or modified sequence opt2 from capsid_protein__Norovirus__AHC12658
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccaucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcggcgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaucaccaaguucacccccaucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 15002 - RNA, 1632 nt, Artificial Sequence
  derived and/or modified sequence opt2 from capsid_protein__Norovirus__AHW99832
augaugauggccuccaaggacgcccccuccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucaucugcugcgucccccccggcuuccagucccgcacccucuccaucgcccaggccacccucuucccccacaucaucgccgacguccgcacccucgagcccaucgagaucccccucgaggacguccgcaacacccucuaccacaccaacgacaaccagcccaccaugcgccuccucugcaugcucuacaccccccuccgcaccggcggcggcuccggcggcaccgacgccuucgucgucgccggccgcguccucaccugccccuccuccgacuucaacuuccucuuccucgucccccccaccgucgagcagaagacccgccccuucuccguccccaacaucccccuccagcuccucuccaacucccgcguccccaaccucauccaguccaugguccucucccccgaccaggcccagaacguccaguuccagaacggccgcugcaccaccgacggccagcuccucggcaccacccccgucuccgucucccagauccucaaguuccgcggcaaggucuccgccggcuccaaggucaucaaccucaccgagcucgacggcucccccuuccucgccuucgaggcccccgcccccaccggcuuccccgaccucggcaccuccgacuggcacgucgagaugucccucaacuccaacucccaguccuccggcaaccccauccuccuccgcgacauccaccccaacuccuccgaguucgucccccaccucggcuccgucugcgucaccgccgccaucgaggucgccggcgacuacaccggcaccauccaguggaccucccagcccuccaacgucacccccguccccgacgucaacuucuggaccaucccccacuacggcuccaaccucgccgaggccucccagcucgcccccgucgucuacccccccggcuucggcgaggccaucgucuacuucaugucccccauccccggccccaacaccgcccacaagcccaaccucguccccugccuccucccccaggaguucgucacccacuucgucuccgagcaggcccccuccaugggcgaggccgcccucguccacuacgucgaccccgacaccaaccgcaaccucggcgaguucaagcucuaccccgagggcuucaucaccugcguccccaacggcaccggcccccagcagcucccccucaacggcgucuucgucuucgccuccugggucucccgcuucuaccagcucaagcccgucggcaccgccuccuccgcccgcggccgccucggcguccgccgcuga

SEQ ID NO: 15003 - RNA, 1647 nt, Artificial Sequence
  derived and/or modified sequence opt2 from capsid_protein__Norovirus__AHZ12735
augaagauggccuccaacgacgccacccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccaggagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgaguucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcaccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccgcgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcguccaguga

SEQ ID NO: 15004 - RNA, 1647 nt, Artificial Sequence
  derived and/or modified sequence opt2 from capsid_protein__Norovirus__AHZ12736
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgaguucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacaacaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcguccaguga

SEQ ID NO: 15005 - RNA, 1647 nt, Artificial Sequence
  derived and/or modified sequence opt2 from capsid_protein__Norovirus__AHZ12737
augaagauggccuccaacgacgccgcccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccgacgacuucgaccagaaccagcccacccgcuucacccccgucggcgucggcgucgaccacgagcccgacuuccagcaguggguccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 15006 - RNA, 1647 nt, Artificial Sequence
  derived and/or modified sequence opt2 from capsid_protein__Norovirus__AHZ12738
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgaguucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcguccaguga

SEQ ID NO: 15007 - RNA, 1647 nt, Artificial Sequence
  derived and/or modified sequence opt2 from capsid_protein__Norovirus__AHZ12739
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgaguucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcaccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcguccaguga

SEQ ID NO: 15008 - RNA, 1623 nt, Artificial Sequence
  derived and/or modified sequence opt2 from capsid_protein__Norovirus__AHZ12912
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucuccaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15009 - RNA, 1623 nt, Artificial Sequence; identical to SEQ ID NO: 15008
  derived and/or modified sequence opt2 from capsid_protein__Norovirus__AHZ12913

SEQ ID NO: 15010 - RNA, 1623 nt, Artificial Sequence
  derived and/or modified sequence opt2 from capsid_protein__Norovirus__AHZ12998
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15011 - RNA, 1623 nt, Artificial Sequence; identical to SEQ ID NO: 15010
  derived and/or modified sequence opt2 from capsid_protein__Norovirus__AHZ13001

SEQ ID NO: 15012 - RNA, 1623 nt, Artificial Sequence; identical to SEQ ID NO: 15010
  derived and/or modified sequence opt2 from capsid_protein__Norovirus__AHZ13004

SEQ ID NO: 15013 - RNA, 1623 nt, Artificial Sequence; identical to SEQ ID NO: 15010
  derived and/or modified sequence opt2 from capsid_protein__Norovirus__AHZ13010

SEQ ID NO: 15014 - RNA, 1623 nt, Artificial Sequence; identical to SEQ ID NO: 15010
  derived and/or modified sequence opt2 from capsid_protein__Norovirus__AHZ13015

SEQ ID NO: 15015 - RNA, 1623 nt, Artificial Sequence; identical to SEQ ID NO: 15010
  derived and/or modified sequence opt2 from capsid_protein__Norovirus__AHZ13020

SEQ ID NO: 15016 - RNA, 1623 nt, Artificial Sequence; identical to SEQ ID NO: 15010
  derived and/or modified sequence opt2 from capsid_protein__Norovirus__AHZ13023

SEQ ID NO: 15017 - RNA, 1545 nt, Artificial Sequence
  derived and/or modified sequence opt2 from capsid_protein__Norovirus__AIC32559
auggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgucgucuga

SEQ ID NO: 15018 - RNA, 1617 nt, Artificial Sequence
  derived and/or modified sequence opt2 from capsid_protein__Norovirus__AID51474
auggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccucgagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 15019 - RNA, 1617 nt, Artificial Sequence; identical to SEQ ID NO: 15018
  derived and/or modified sequence opt2 from capsid_protein__Norovirus__AID51477

SEQ ID NO: 15020 - RNA, 1617 nt, Artificial Sequence; identical to SEQ ID NO: 15018
  derived and/or modified sequence opt2 from capsid_protein__Norovirus__AID51480

SEQ ID NO: 15021 - RNA, 1617 nt, Artificial Sequence; identical to SEQ ID NO: 15018
  derived and/or modified sequence opt2 from capsid_protein__Norovirus__AID51483

SEQ ID NO: 15022 - RNA, 1617 nt, Artificial Sequence; identical to SEQ ID NO: 15018
  derived and/or modified sequence opt2 from capsid_protein__Norovirus__AID51486

SEQ ID NO: 15023 - RNA, 1617 nt, Artificial Sequence; identical to SEQ ID NO: 15018
  derived and/or modified sequence opt2 from capsid_protein__Norovirus__AID51489

SEQ ID NO: 15024 - RNA, 1617 nt, Artificial Sequence; identical to SEQ ID NO: 15018
  derived and/or modified sequence opt2 from capsid_protein__Norovirus__AID51492

SEQ ID NO: 15025 - RNA, 1617 nt, Artificial Sequence; identical to SEQ ID NO: 15018
  derived and/or modified sequence opt2 from capsid_protein__Norovirus__AID51495

SEQ ID NO: 15026 - RNA, 1623 nt, Artificial Sequence
  derived and/or modified sequence opt2 from capsid_protein__Norovirus__AIE40036
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccaucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccaucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15027 - RNA, 1647 nt, Artificial Sequence
  derived and/or modified sequence opt2 from capsid_protein__Norovirus__AJW87644
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucauccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacaccaccacccgcgcccacgaggccaagaucgacaccaccuccggccgcuucacccccaagcucggcucccucgagaucuccaccgaguccgacgacuucgaccagaacaagcccacccgcuucacccccgucggcaucggcgucgaccacgaggccgacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaucaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15028 - RNA, 1623 nt, Artificial Sequence
  derived and/or modified sequence opt2 from capsid_protein__Norovirus__ALG05457
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucucccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15029 - RNA, 1623 nt, Artificial Sequence
  derived and/or modified sequence opt2 from capsid_protein__Norovirus__ALG05460
augaagauggccuccaacgacgccgcccccuccaacgacggcgccgccggccucguccccgagggcaacgacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacugcuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccacccaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15030 - RNA, 1623 nt, Artificial Sequence
  derived and/or modified sequence opt2 from capsid_protein__Norovirus__ALL73873
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15031 - RNA, 1623 nt, Artificial Sequence; identical to SEQ ID NO: 14230
  derived and/or modified sequence opt2 from capsid_protein__Norovirus__ALL73876

SEQ ID NO: 15032 - RNA, 1623 nt, Artificial Sequence
  derived and/or modified sequence opt2 from capsid_protein__Norovirus__ALL73879
augaagauggccuccaacgacgccgcccccuccaacgacggcgccgccggccucguccccgagggcaacaacgagacccucccccucgagcccgucgccggcgccgccaucgccgccuccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15033 - RNA, 1623 nt, Artificial Sequence; identical to SEQ ID NO: 14230
  derived and/or modified sequence opt2 from capsid_protein__Norovirus__ALL73882

SEQ ID NO: 15034 - RNA, 1623 nt, Artificial Sequence; identical to SEQ ID NO: 14230
  derived and/or modified sequence opt2 from capsid_protein__Norovirus__ALL73888

SEQ ID NO: 15035 - RNA, 1623 nt, Artificial Sequence
  derived and/or modified sequence opt2 from capsid_protein__Norovirus__ALQ43927
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcccccucuga

SEQ ID NO: 15036 - RNA, 1623 nt, Artificial Sequence
  derived and/or modified sequence opt2 from capsid_protein__Norovirus__ALQ43928
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcccccucuga

SEQ ID NO: 15037 - RNA, 1623 nt, Artificial Sequence; identical to SEQ ID NO: 13589
  derived and/or modified sequence opt2 from capsid_protein__Norovirus__ALQ44123

SEQ ID NO: 15038 - RNA, 1623 nt, Artificial Sequence; identical to SEQ ID NO: 14230
  derived and/or modified sequence opt2 from capsid_protein__Norovirus__ALQ44124

SEQ ID NO: 15039 - RNA, 1623 nt, Artificial Sequence; identical to SEQ ID NO: 14230
  derived and/or modified sequence opt2 from capsid_protein__Norovirus__ALQ44125

SEQ ID NO: 15040 - RNA, 1644 nt, Artificial Sequence
  derived and/or modified sequence opt2 from capsid_protein__Norovirus__BAB83514
augaagauggccuccuccgacgccgcccccuccaccgacggcuccgccggccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggagguccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccucccucacccucgacgagcucuccaacucccgcuuccccgcccccaucguccagcucuacaccaacccccacgacaaccucgucguccagccccagaacggccgcugcaccaucgacggccuccuccagggcaccacccagcucgucuccugcaacgucugcuccuuccgcggcaccaucggcgacggccagcccgccucccacuccgaggaggagaucaugcccauggccuucaacauccagcgcgagaucaugcucgagaaccucgacggcacccccuacgaccccgccgacgacauccccgccguccucggcucccccgacuuccagggcgucaucuucggcauccucucccagcgcaacaccgacggccagacccgcgcccacgaggccaaggucgacacccgcgccgcccgcuucgcccccaagcucggcuucgucgucgccaccgucgaguccaccgacuuccacgccaaccagcccucccgcuucacccccgucggccucggcggcgacaacaaccaggacuucaaccaguggcgccuccccgccuacggcggcgcccucaccaacaacaccaaccucgccccccccgucaugcccgucuaccccggcgagcagcuccucuucuuccgcucccagcuccccuccuccggcggcgucgucggcggcuggcucgacugccuccucccccaggaguggguccagcacuucuuccaggaguccgccaccucccaguccgacgucgcccucguccgcuacaucaaccccaccaccggccgcguccucuucgaggccaagcuccacaagcagggcuuccucaccgucgccgccuccggcuccuacccccucgucguccccgccgacggcuacuuccgcuucgaguccugggucaaccaguucuacacccucgcccccaugggcaacggcuccggccgccgccgcgcccgcuga

SEQ ID NO: 15041 - RNA, 1644 nt, Artificial Sequence
  derived and/or modified sequence opt2 from capsid_protein__Norovirus__BAB83516
augaagauggccuccuccgacgccccccccuccaccgacggcuccgccggccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggagguccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccggccucacccucgacgagcucuccaacucccgcuuccccgcccccaucguccagcucuacaccaacccccacgacaaccucaucguccagccccagaacggccgcugcaccaucgacggccuccuccagggcaccacccagcucgucuccugcaacgucugcuccuuccgcggcaccaugggcgagggccagcccgccgcccacuccgaggacgagaucaugcccauggccuucaacguccagcgcgagaucaugcucgagaaccucgacggcucccccuacgaccccaccgacgacauccccgccguccucggcucccccgacuuccagggcgucauguucggcauccucucccagcgcaacaccgacggccagacccgcgcccacgaggccaaggucgacacccgcgccgcccgcuucgcccccaagcucggcuucgucgucgccaccgucgaguccaccgacuuccacgccaaccagcccucccgcuucacccccgucggccucggcggcgacaccaaccgcgacuucaaccaguggcagcuccccgccuacggcggcgcccucaccaacaacaccaaccucgccccccccgucaugcccgucuaccccggcgagcagcuccucuucuuccgcucccagcuccccuccuccggcggcgucgucgccggcuggcucgacugccuccucccccaggaguggguccagcacuucuuccaggaguccgccaccucccaguccgacgucgcccucguccgcuacgucaaccccaccaccggccgcguccucuucgaggccaagcuccacaagcagggcuuccucaccgucgccgccuccggcuccuacccccucgucguccccgccgacggcuacuuccgcuucgaguccugggucaaccaguucuacacccucgcccccaugggcaacggcuccggccgccgccgcgcccgcuga

SEQ ID NO: 15042 - RNA, 1629 nt, Artificial Sequence
  derived and/or modified sequence opt2 from capsid_protein__Norovirus__BAD72797
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcccccccuucgaccccuccgaggacauccccgccccccucggcguccccgacuuccagggccgcgucuucggcgucaucucccagcgcgacaagcagaacgccgccggccacuccgagcccgccaaccgcggccacgacgccgucguccccaccuacaccgcccaguacacccccaagcucggccagguccagaucggcaccuggcagaccgacgaccuccaggucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucgucaccgucuccuccaacaccuccgcccccgucgucguccccgccaacggcuacuuccgcuucgacuccugggucaaccaguucuacucccucgcccccaugggcgccggcaacggccgccgccgcguccaguga

SEQ ID NO: 15043 - RNA, 1647 nt, Artificial Sequence
  derived and/or modified sequence opt2 from capsid_protein__Norovirus__BAD72798
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuucuacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgagucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacguccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccuccgacuucgaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucggcgccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15044 - RNA, 1647 nt, Artificial Sequence
  derived and/or modified sequence opt2 from capsid_protein__Norovirus__BAD72799
augaagauggccuccaacgacgccgcccccuccaacgacggcgccgccggccucguccccgaguccaacaacgaggucauggcccucgagcccgucgccggcgccucccucgccgcccccgucaccggccagaccaacaucaucgaccccuggauccgcaugaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcauggagguccagaucaugcucgccggcaacgccuucaccgccggcaagcucaucuucgccgccguccccccccacuuccccaucgagaaccucucccccccccagaucaccauguucccccacgucaucaucgacguccgcacccucgagcccguccuccuccccaugcccgacauccgcaacuccuucuuccacuucauccagcgcgacgagcccaagaugcgccucgucgccaugcucuacaccccccuccgcuccaacggcuccggcgacgacgucuucaccgucuccugccgcguccucacccgccccacccccgacuucgacuucaccuaccucgucccccccaccgucgaguccaaguccaagcccuucacccuccccauccucacccucggcgagcucaccaacucccgcuucccccuccccaucgacguccucuacaccaaccccaacgaguccgccaucguccagugccagaacggccgcugcacccucggcggcgagcuccagggcaccgcccagcuccuccccaccggcaucugcgccuuccgcggcaaggucacccagcagguccaggacgagcaccgcggcacccacuggaacaugaccgucaccaagcucaacggcacccccuucgaccccaccgaggacguccccgccccccucggcacccccgacuucuccggccagaucuacggcgucaucucccagcgcaacaccaacaccguccccggcgagggcaaccuccccgccaaccgcgcccacgaggccgucaucgccaccuacucccccaaguucacccccaagcucggcaacauccaguucuccaccugggagacccaggacgucuccuccggccagcccaccaaguucacccccgucggccucgccuccgucgacgccaacucccacuucgaccaguggacccuccccuccuacuccggcgcccucacccucaacaugaaccucgcccccuccgucgcccccgucuuccccggcgagugccuccucuucuuccgcuccuucaucccccucaagggcggcuacggcaaccccgccaucgacugccucaugccccaggaguggguccagcaccucuaccaggaguccgcccccucccucuccgacgucgcccucguccgcuacgucaaccccgagaccggccgcacccucuucgaggccaagcuccaccgcaacggcuuccucaccgucgcccgcaacuccgccggccccgucgucgcccccaccaacggcuacuuccgcuucgacuccugggucaaccaguucuacacccucgcccccaugggcaacggcuccggccgccgccgcauccaguga

SEQ ID NO: 15045 - RNA, 1623 nt, Artificial Sequence
  derived and/or modified sequence opt2 from capsid_protein__Norovirus__BAD72800
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucgcccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacaaccagcaguccgaccagcgcaugcgccucaucgccaugcucuacaccccccuccgcuccaacggcuccggcgacgacgucuucaccgucuccugccgcguccucacccgccccucccccgacuuccacuuccacuaccucgucccccccaccgucgaguccaagaccaagcccuucuccguccccguccucacccucaacgagcucaccaacucccgcuuccccguccccaucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucgccgacgaccgccaccucuggaacauccaggucuccaaccucaacggcacccccuucgaccccaccgacgacguccccgccccccucggcaugcccgacuucuccggccagaucuucggcgucgucuccgagcgcgacaccggcaccaaccccgccaaccgcgcccacgacgccguccucgccaccuacuccgccaaguacacccccaagcucggcuccguccagaucggcaccugggacaccgaggaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggccacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaaggagggcuucaucaccgucuccuccaccgagaaccgccccgucaucgucccccccaacggcuacuuccgcuucgacuccugggucaaccaguucuacucccucgcccccaugggcaccggcaacggccgccgccgcauccaguga

SEQ ID NO: 15046 - RNA, 1620 nt, Artificial Sequence
  derived and/or modified sequence opt2 from capsid_protein__Norovirus__BAD88558
augaagauggccuccaacgacgucaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaaguccuucaccguccccguccucaccgucgaggagaugaccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcauccccgacuucgucggcaagauccagggccuccucacccagaccacccgcgccgacggcuccacccgcgcccacaaggccaccgucuccaccggcuccguccacuucacccccaagcucggcuccguccaguucuccaccgacaccgacaacgacuuccagcccggccagaacaccaaguucacccccgucggcgucauccaggacggcgaccgccaccagaacgagccccagcaguggguccuccccgacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaguccgcccccgcccaguccgacgucgcccuccuccgcuucgucaaccccgacaccaaccgcguccucuucgagugcaagcuccacaaguccggcuacaucaccgucgcccacaccggccagcacgaccucauccucccccccaacggcuacuuccgcuucgacuccugggucaaccaguucuacacccucgcccccaugggcaacggcgccggccgccgccgcgcccccuga

SEQ ID NO: 15047 - RNA, 1623 nt, Artificial Sequence
  derived and/or modified sequence opt2 from capsid_protein__Norovirus__BAD98240
augaagauggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccucgagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 15048 - RNA, 1632 nt, Artificial Sequence
  derived and/or modified sequence opt2 from capsid_protein__Norovirus__BAE43833
augaugauggccuccaaggacgcccccaccaacauggacggcaccuccggcgccggccagcucguccccgaggccuccaccgccgagcccaucuccauggagcccgucgccggcgccgccaccgccgccgccaccgccggccaggucaacaugaucgaccccuggaucauguccaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcgucccccccggcuucgccgcccagaacgucuccaucgcccaggccaccauguucccccacgucaucgccgacguccgcguccucgagcccaucgaggucccccucgaggacguccgcaacguccucuuccacaacaacgacuccacccccaccaugcgccucaucugcaugcucuacaccccccuccgcgccuccggcuccuccuccggcaccgaccccuucgucaucgccggccgcguccucaccugccccucccccgacuucaacuuccucuuccucgucccccccaacgucgagcagaagaccaagcccuucuccguccccaaccucccccucaacguccucuccaacucccgcguccccucccucaucaaguccaugauggucucccaggaccacggccagaugguccacuuccagaucggccgcgucacccucgacggccagcuccagggcaccacccccaccuccgccucccagcucugcaagauccgcggcaccgucuaccacgccaccggcggccagggccucaaccucaccgagaucgacggcacccccuaccacgccuucgagucccccgcccccaucggcuuccccgaccucggcgagugcgacuggcacaucaacgccucccccgccaacgccuucaccgacggcuccaucauccaccgcaucgacgucgcccaggacuccaccuucgccccccaccucggcaccauccacuacaccaacgccaacuacgacgccaacgucucccucaucugcucccucgaguggcucuccccccccuccggcggcgcccccaaggucaaccccugggccaucccccgcuacggcuccacccucaccgaggccgcccagcucgccccccccaucuacccccccggcuucggcgaggccaucgucuucuucauguccgacuuccccaucgccaacggcuccgacggccucuccguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucaucuccugggucucccgcuucuaccagcucaagcccgucggcaccaccggccccguccgccgccucggcauccgccgcuccuga

SEQ ID NO: 15049 - RNA, 1647 nt, Artificial Sequence
  derived and/or modified sequence opt2 from capsid_protein__Norovirus__BAE48588
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgcccgcaagaucaucuucgccgccaucccccccaacuuccccaucgacaaccucuccgccgcccacaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccacccucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgcccgcgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaccaccaucgccaagaacggcgacucccccaucaccgucccccccaacggcuacuuccgcuucgaguccugggucaaccccuucuacacccucgcccccaugggcaccggcaacggccgccgccgcaaccaguga

SEQ ID NO: 15050 - RNA, 1647 nt, Artificial Sequence
  derived and/or modified sequence opt2 from capsid_protein__Norovirus__BAE48589
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccuacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucucccuccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15051 - RNA, 1647 nt, Artificial Sequence
  derived and/or modified sequence opt2 from capsid_protein__Norovirus__BAE48590
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucgaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaccuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgaguccaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccaccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccgcggcgagcagcuccucuucuuccgcucccagcuccccuccuccggcggccgcuccaacggcacccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15052 - RNA, 1644 nt, Artificial Sequence
  derived and/or modified sequence opt2 from capsid_protein__Norovirus__BAE92970
augaagauggccuccaacgacgccucccccuccaccgacggcuccgccggccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggagguccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccucccucacccucgacgagcucuccaacucccgcuuccccgcccccaucguccagcucuacaccaacccccacgacaaccucgucguccagccccagaacggccgcugcaccaucgacggccuccuccagggcaccacccagcucgucuccugcaacgucugcuccuuccgcggcacccucggcgacggccagcccgccucccacuccgaggaggagaucaugcccauggccuucaacguccagcgcgagaucaugcucgagaaccucgacggcucccccuacgaccccaccgacgacauccccgccguccucggcucccccgacuuccagggcgucgucuucggcauccucucccagcgcaacaccgacggccagacccgcgcccacgaggccaaggucgacacccgcgccgcccgcuucgcccccaagcucggcuucgucgucgccaccgucgaguccaccgacuuccacgccaaccagcccucccgcuucacccccgucggccucggcggcgacggcaaccaggacuucaaccaguggucccuccccgccuacggcggcgcccucaccaacaacaccaaccucgccccccccgccaugcccgucuaccccggcgagcagcuccucuucuuccgcucccagcuccccuccuccggcggcgucgucggcggcuggcucgacugccuccucccccaggaguggguccagcacuucuuccaggaguccgccaccucccaguccgacgucgcccucguccgcuacaucaaccccaccaccggccgcguccucuucgaggccaagcuccacaagcagggcuuccucaccgucgccgccuccggcuccuacccccucgucguccccgccgacggcuacuuccgcuucgaguccugggucaaccaguucuacacccucgcccccaugggcaacggcuccggccgccgcuccgcccgcuga

SEQ ID NO: 15053 - RNA, 1623 nt, Artificial Sequence
  derived and/or modified sequence opt2 from capsid_protein__Norovirus__BAE98191
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15054 - RNA, 1623 nt, Artificial Sequence
  derived and/or modified sequence opt2 from capsid_protein__Norovirus__BAE98194
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15055 - RNA, 1623 nt, Artificial Sequence
  derived and/or modified sequence opt2 from capsid_protein__Norovirus__BAE98197
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15056 - RNA, 1623 nt, Artificial Sequence
  derived and/or modified sequence opt2 from capsid_protein__Norovirus__BAF45861
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggccacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15057 - RNA, 1620 nt, Artificial Sequence
  derived and/or modified sequence opt2 from capsid_protein__Norovirus__BAF74508
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcgacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 15058 - RNA, 1620 nt, Artificial Sequence
  derived and/or modified sequence opt2 from capsid_protein__Norovirus__BAF74509
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 15059 - RNA, 1620 nt, Artificial Sequence
  derived and/or modified sequence opt2 from capsid_protein__Norovirus__BAF74510
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuucugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 15060 - RNA, 1620 nt, Artificial Sequence
  derived and/or modified sequence opt2 from capsid_protein__Norovirus__BAF74511
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccuggaucaaccaguucuacacccucgcccccaugggcaacggcgccggccgccgccgcgcccucuga

SEQ ID NO: 15061 - RNA, 1620 nt, Artificial Sequence
  derived and/or modified sequence opt2 from capsid_protein__Norovirus__BAF74512
augaagauggccuccaacgacgccacccccuccgacggcuccaccgccaaccucguccccgaggucaacaacgaggucauggcccucgagcccgucgucggcgccgccaucgccgcccgcgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccgucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcuccaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgcuccuccgcccucuga

SEQ ID NO: 15062 - RNA, 1620 nt, Artificial Sequence
  derived and/or modified sequence opt2 from capsid_protein__Norovirus__BAF74513
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccgucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcuccaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 15063 - RNA, 1623 nt, Artificial Sequence
  derived and/or modified sequence opt2 from capsid_protein__Norovirus__BAF74514
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcacccuccgcggcgacgucacccacaucgccggcacccacaacuacaccaugaaccucgccucccagaacuggaacaacuacgaccccaccgaggagauccccgccccccucggcacccccgacuucgucggccgcauccagggcguccucacccagaccacccgcggcgacggcuccacccgcggccacaaggccaccgucuccaccggcgacguccacuucacccccaagcucggcuccguccaguucaacaccgacaccaacaacgacuucgagaucggccagaacacccgcuucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15064 - RNA, 1620 nt, Artificial Sequence
  derived and/or modified sequence opt2 from capsid_protein__Norovirus__BAF74515
augaagauggccuccaacgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuacaccggccccuccuccgccaucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucuccaccgacaccgacaacgacuuccagcccggccagaacaccaaguucacccccgucggcgucauccaggacggcgaccgccaccagaacgagccccagcaguggguccuccccgacuucuccggccgcaccggccacaacguccaccucgcccccgccgucgcccccaccuuccccggcgagcagcuccucuucuuccgcuccaccaugcccggccgcuccggcuaccccaacaugaaccucgacugccuccucccccaggaguggguccuccacuucuaccaggaguccgcccccgcccaguccgacgucgcccuccuccgcuucgucaaccccgacaccaaccgcguccucuucgagugcaagcuccacaaguccggcuacaucaccgucgcccacaccggccaccacgaccucauccucccccccaacggcuacuuccgcuucgacuccugggucaaccaguucuacacccucgcccccaugggcaacggcgccggccgccgccgcgcccccuga

SEQ ID NO: 15065 - RNA, 1623 nt, Artificial Sequence
  derived and/or modified sequence opt2 from capsid_protein__Norovirus__BAF74516
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaaccucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccggcgaggagaugaccaacucccgcuuccccaucccccucgagaagcucuucaccggccccuccggcgccuucgucguccagccccagaacggccgcugcaccaccgacggcguccuccucggcaccacccagcuccuccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15066 - RNA, 1623 nt, Artificial Sequence
  derived and/or modified sequence opt2 from capsid_protein__Norovirus__BAF74517
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15067 - RNA, 1623 nt, Artificial Sequence
  derived and/or modified sequence opt2 from capsid_protein__Norovirus__BAF74518
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccguccaguucaacaccgacaccaacaacgacuucgagaccggccagaacacccgcuucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15068 - RNA, 1623 nt, Artificial Sequence
  derived and/or modified sequence opt2 from capsid_protein__Norovirus__BAF74519
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuaccucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15069 - RNA, 1623 nt, Artificial Sequence
  derived and/or modified sequence opt2 from capsid_protein__Norovirus__BAF74520
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucauccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15070 - RNA, 1623 nt, Artificial Sequence
  derived and/or modified sequence opt2 from capsid_protein__Norovirus__BAF74521
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccuccuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15071 - RNA, 1623 nt, Artificial Sequence
  derived and/or modified sequence opt2 from capsid_protein__Norovirus__BAF74522
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccuccuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccguccaguucgacaccgacaccaacuccgacuucgagaccggccagaacaccaaguucacccccgucggcgucguccaggacggcaacggcgcccaccagaacgagccccagcaguggguccuccccuccuacuccggccgcaccggccacaacgcccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15072 - RNA, 1623 nt, Artificial Sequence; identical to SEQ ID NO: 13717
  derived and/or modified sequence opt2 from capsid_protein__Norovirus__BAF74523

SEQ ID NO: 15073 - RNA, 1623 nt, Artificial Sequence; identical to SEQ ID NO: 13717
  derived and/or modified sequence opt2 from capsid_protein__Norovirus__BAF74524

SEQ ID NO: 15074 - RNA, 1623 nt, Artificial Sequence; identical to SEQ ID NO: 13717
  derived and/or modified sequence opt2 from capsid_protein__Norovirus__BAF74525

SEQ ID NO: 15075 - RNA, 1623 nt, Artificial Sequence
  derived and/or modified sequence opt2 from capsid_protein__Norovirus__BAF74526
augaagauggccuccaacgacgccacccccuccgacggcuccaccgccaaccucguccccgaggucaacaccgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcaccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccauccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15076 - RNA, 1623 nt, Artificial Sequence
  derived and/or modified sequence opt2 from capsid_protein__Norovirus__BAF74527
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccauccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15077 - RNA, 1620 nt, Artificial Sequence
  derived and/or modified sequence opt2 from capsid_protein__Norovirus__BAF95499
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccgucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcuccaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 15078 - RNA, 1620 nt, Artificial Sequence
  derived and/or modified sequence opt2 from capsid_protein__Norovirus__BAF95501
augaagauggccuccaacgacgucaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucuccaccgacaccgacaacgacuuccagcccggccagaacaccaaguucacccccgucggcgucauccaggacggcgaccgccaccagaacgagccccagcaguggguccuccccgacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaguccgcccccgcccaguccgacgucgcccuccuccgcuucgucaaccccgacaccaaccgcguccucuucgagugcaagcuccacaaguccggcuacaucaccgucgcccacaccggccagcacgaccucauccucccccccaacggcuacuuccgcuucgacuccugggucaaccaguucuacacccucgcccccaugggcaacggcgccggccgccgccgcgcccccuga

SEQ ID NO: 15079 - RNA, 1623 nt, Artificial Sequence
  derived and/or modified sequence opt2 from capsid_protein__Norovirus__BAF95503
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccaccaagggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15080 - RNA, 1623 nt, Artificial Sequence
  derived and/or modified sequence opt2 from capsid_protein__Norovirus__BAF95505
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccaccaagggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15081 - RNA, 1623 nt, Artificial Sequence; identical to SEQ ID NO: 15054
  derived and/or modified sequence opt2 from capsid_protein__Norovirus__BAF95507

SEQ ID NO: 15082 - RNA, 1623 nt, Artificial Sequence
  derived and/or modified sequence opt2 from capsid_protein__Norovirus__BAF95509
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15083 - RNA, 1623 nt, Artificial Sequence; identical to SEQ ID NO: 13739
  derived and/or modified sequence opt2 from capsid_protein__Norovirus__BAF95511

SEQ ID NO: 15084 - RNA, 1623 nt, Artificial Sequence
  derived and/or modified sequence opt2 from capsid_protein__Norovirus__BAF95513
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15085 - RNA, 1623 nt, Artificial Sequence; identical to SEQ ID NO: 13565
  derived and/or modified sequence opt2 from capsid_protein__Norovirus__BAF95515

SEQ ID NO: 15086 - RNA, 1623 nt, Artificial Sequence
  derived and/or modified sequence opt2 from capsid_protein__Norovirus__BAF95517
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15087 - RNA, 1623 nt, Artificial Sequence
  derived and/or modified sequence opt2 from capsid_protein__Norovirus__BAF95519
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccaccacccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15088 - RNA, 1623 nt, Artificial Sequence
  derived and/or modified sequence opt2 from capsid_protein__Norovirus__BAF95521
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15089 - RNA, 1623 nt, Artificial Sequence; identical to SEQ ID NO: 14265
  derived and/or modified sequence opt2 from capsid_protein__Norovirus__BAF95523

SEQ ID NO: 15090 - RNA, 1623 nt, Artificial Sequence; identical to SEQ ID NO: 13565
  derived and/or modified sequence opt2 from capsid_protein__Norovirus__BAF95525

SEQ ID NO: 15091 - RNA, 1623 nt, Artificial Sequence
  derived and/or modified sequence opt2 from capsid_protein__Norovirus__BAF95527
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgacguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15092 - RNA, 1623 nt, Artificial Sequence
  derived and/or modified sequence opt2 from capsid_protein__Norovirus__BAF95529
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15093 - RNA, 1623 nt, Artificial Sequence; identical to SEQ ID NO: 13702
  derived and/or modified sequence opt2 from capsid_protein__Norovirus__BAF95531

SEQ ID NO: 15094 - RNA, 1623 nt, Artificial Sequence; identical to SEQ ID NO: 14406
  derived and/or modified sequence opt2 from capsid_protein__Norovirus__BAG30923

SEQ ID NO: 15095 - RNA, 1629 nt, Artificial Sequence
  derived and/or modified sequence opt2 from capsid_protein__Norovirus__BAG34630
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcagaacgccgccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15096 - RNA, 1629 nt, Artificial Sequence
  derived and/or modified sequence opt2 from capsid_protein__Norovirus__BAG34632
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguucaccucccccaacgaggucaucuccguccagugccagaacggccgcugcacccucgacggcgagcuccagggcaccacccagcuccaggucuccggcaucugcgucuucaagggcgaggucaccgcccaccuccacgacaacgaccaccucuacaacaucaccaucaccaaccucaacggcucccccuucgaccccuccgaggacguccccgccccccucggcguccccgacuuccagggccgcgucuucggcgucaucucccagcgcgacaaccacaacgccuccggccacaaccagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacgucgagcacuucaaccagugggucgucccccgcuacgccggcgcccucaaccucaacaccaaccucgcccccuccgucgcccccgucuuccccggcgagcgccuccucuucuuccgcuccuaccucccccucaagggcggcuacggcaaccccgucaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15097 - RNA, 1629 nt, Artificial Sequence
  derived and/or modified sequence opt2 from capsid_protein__Norovirus__BAG34634
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacgccuccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15098 - RNA, 1629 nt, Artificial Sequence
  derived and/or modified sequence opt2 from capsid_protein__Norovirus__BAG34636
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguucaccucccccaacgaggucaucuccguccagugccagaacggccgcugcacccucgacggcgagcuccagggcuccacccagcuccaggucuccggcaucugcgccuucaagggcgaggucaccgcccaccuccacgacaacgaccaccucuacaacaucaccaucaccaaccucaacggcucccccuucgaccccuccgaggacguccccgccccccucggcguccccgacuuccagggccgcgucuucggcgucaucucccagcgcgacaaccacaacgccuccggccacaaccagcccgccaaccgcggccacgacgccgucguccccaccuacaccucccaguacacccccaagcucggccagauccagaucggcaccuggcagaccgacgaccucaccgucaaccagcccgucaaguucacccccgucggccucaacgacgucgagcacuucaaccagugggucgucccccgcuacgccggcgcccucaaccucaacaccaaccucgcccccuccgucgcccccgucuuccccggcgagcgccuccucuucuuccgcuccuaccucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15099 - RNA, 1629 nt, Artificial Sequence; identical to SEQ ID NO: 13638
  derived and/or modified sequence opt2 from capsid_protein__Norovirus__BAG34638

SEQ ID NO: 15100 - RNA, 1629 nt, Artificial Sequence; identical to SEQ ID NO: 13638
  derived and/or modified sequence opt2 from capsid_protein__Norovirus__BAG34640

SEQ ID NO: 15101 - RNA, 1629 nt, Artificial Sequence; identical to SEQ ID NO: 13638
  derived and/or modified sequence opt2 from capsid_protein__Norovirus__BAG34642

SEQ ID NO: 15102 - RNA, 1629 nt, Artificial Sequence; identical to SEQ ID NO: 13638
  derived and/or modified sequence opt2 from capsid_protein__Norovirus__BAG34644

SEQ ID NO: 15103 - RNA, 1629 nt, Artificial Sequence; identical to SEQ ID NO: 13638
  derived and/or modified sequence opt2 from capsid_protein__Norovirus__BAG34646

SEQ ID NO: 15104 - RNA, 1629 nt, Artificial Sequence
  derived and/or modified sequence opt2 from capsid_protein__Norovirus__BAG34648
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcuccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacucccccggccacaacgagcccgccaaccgcggccacgacgccgucguccccaccuacaccucccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15105 - RNA, 1629 nt, Artificial Sequence; identical to SEQ ID NO: 13638
  derived and/or modified sequence opt2 from capsid_protein__Norovirus__BAG34650

SEQ ID NO: 15106 - RNA, 1629 nt, Artificial Sequence
  derived and/or modified sequence opt2 from capsid_protein__Norovirus__BAG34652
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacucccccggccacaacgagcccgccaaccgcggccacgacgccgucguccccaccuacaccccccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccaucuccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15107 - RNA, 1629 nt, Artificial Sequence
  derived and/or modified sequence opt2 from capsid_protein__Norovirus__BAG34654
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacucccccggccacaacgaguccgccaaccgcggccacgacgccgucguccccaccuacaccucccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15108 - RNA, 1629 nt, Artificial Sequence
  derived and/or modified sequence opt2 from capsid_protein__Norovirus__BAG34656
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacucccccggccacaacgagcccgccaaccgcggccacgacgccgucguccccaccuacaccucccaguacacccccaagcucggccagauccagaucggcaccuggcagaccgacgaccucaucgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15109 - RNA, 1629 nt, Artificial Sequence; identical to SEQ ID NO: 13638
  derived and/or modified sequence opt2 from capsid_protein__Norovirus__BAG34658

SEQ ID NO: 15110 - RNA, 1629 nt, Artificial Sequence
  derived and/or modified sequence opt2 from capsid_protein__Norovirus__BAG34662
augaagauggccuccaacgacgccgcccccuccaccgacggcgccgccggccucguccccgaguccaacuccgaggucauggcccucgagcccgucgccggcgccgcccucgccgcccccgucaccggccagaccaacaucaucgaccccuggauccgcuccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccagaacgacgaccaccucuacaacaucaccaucaccaaccucaacggcucccccuucgaccccuccgaggacauccccgccccccucggcguccccgacuuccagggccgcgucuucggcgucaucacccagcgcgacaagcagaacgccaccggccagaaccagcccgccaaccgcggccacgacgccgucguccccaccuacaccgcccaguacacccccaagcucggccagauccagaucggcaccuggcagaccgacgaccucaaggucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuaccucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15111 - RNA, 1629 nt, Artificial Sequence
  derived and/or modified sequence opt2 from capsid_protein__Norovirus__BAG34664
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacacccccgccccccucggcguccccgacuuccagggccgcgucuucggcaucaucucccagcgcgacaagcagaacgccaccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15112 - RNA, 1629 nt, Artificial Sequence; identical to SEQ ID NO: 13638
  derived and/or modified sequence opt2 from capsid_protein__Norovirus__BAG34666

SEQ ID NO: 15113 - RNA, 1629 nt, Artificial Sequence
  derived and/or modified sequence opt2 from capsid_protein__Norovirus__BAG34668
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcauccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacucccccggccacaacgagcccgccaaccgcggccacgacgccgucguccccaccuacaccucccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15114 - RNA, 1629 nt, Artificial Sequence
  derived and/or modified sequence opt2 from capsid_protein__Norovirus__BAG34670
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcuccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacucccccggccacaacgagcccgccaaccgcggccacgacgccgucguccccaccuacaccucccaguacacccccaagcucggccagauccagaucggcaccuggcagaccgacgaccucaccgucaaccagcccgccaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15115 - RNA, 1623 nt, Artificial Sequence
  derived and/or modified sequence opt2 from capsid_protein__Norovirus__BAG55289
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15116 - RNA, 1629 nt, Artificial Sequence
  derived and/or modified sequence opt2 from capsid_protein__Norovirus__BAG68707
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcagaacgccaccggccacaacgagcccgccaaccgcggccacgacgucgucguccccaccuacaccgcccaguacacccccaagcucggccagauccagaucggcaccuggcagaccgacgaccucaccgucaaccagcccgccaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15117 - RNA, 1629 nt, Artificial Sequence
  derived and/or modified sequence opt2 from capsid_protein__Norovirus__BAG68708
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgacuccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcagaacgccaccggccacuccgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucgcccccgccaacggcuacuuccgcuucgacuccugggucaaccaguucuacucccucgcccccaugggcaccggcaacggccgccgccgcguccaguga

SEQ ID NO: 15118 - RNA, 1629 nt, Artificial Sequence
  derived and/or modified sequence opt2 from capsid_protein__Norovirus__BAG68709
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcagaacgccaccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15119 - RNA, 1629 nt, Artificial Sequence
  derived and/or modified sequence opt2 from capsid_protein__Norovirus__BAG68711
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaucgccuccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaguccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcacccaguga

SEQ ID NO: 15120 - RNA, 1629 nt, Artificial Sequence
  derived and/or modified sequence opt2 from capsid_protein__Norovirus__BAG68712
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacgccuccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15121 - RNA, 1629 nt, Artificial Sequence; identical to SEQ ID NO: 15120
  derived and/or modified sequence opt2 from capsid_protein__Norovirus__BAG68713

SEQ ID NO: 15122 - RNA, 1629 nt, Artificial Sequence
  derived and/or modified sequence opt2 from capsid_protein__Norovirus__BAG68714
augaagauggccuccaacgacgccgcccccuccaccgacggcgccgccggccucguccccgaguccuccaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacgccuccggccacaacgagcccgccaaccgcggccacgacgccgucguccccaccuacaccgcccaguacacccccaagcucggccagguccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15123 - RNA, 1629 nt, Artificial Sequence
  derived and/or modified sequence opt2 from capsid_protein__Norovirus__BAG68715
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15124 - RNA, 1629 nt, Artificial Sequence; identical to SEQ ID NO: 13644
  derived and/or modified sequence opt2 from capsid_protein__Norovirus__BAG68716

SEQ ID NO: 15125 - RNA, 1647 nt, Artificial Sequence
  derived and/or modified sequence opt2 from capsid_protein__Norovirus__BAG68799
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccgccuccggccgcuucacccccaagcucggcucccucgagaucuccaccgaguccgacgacuucgaccagaacaagcccacccgcuucacccccgucggcaucggcgucgaccacgaggaggacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15126 - RNA, 1647 nt, Artificial Sequence
  derived and/or modified sequence opt2 from capsid_protein__Norovirus__BAG68800
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaccuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucgacuacuacuggcacauccagcucgacaaccucaacggcacccccuacgaccccgccgaggacauccccggcccccucggcacccccgacuuccgcggcaaggucuucggcgucgccucccagcgcaaccccgacaccaccacccgcgcccacgaggccaagaucgacaccgccuccggccgcuucacccccaagcucggcucccucgagaucuccaccgaguccgacgacuucgaccagaacaagcccacccgcuucacccccgucggcaucggcgucgaccacgaggaggacuuccagcaguggacccuccccaacuacgccggccaguucacccacaacaugaaccucgcccccgccgucgcccccaacuuccccggcgagcagguccucuucuuccgcucccagcuccccuccuccggcggccgcuccaacggcauccucgacugccucgucccccaggaguggguccagcacuucuaccaggaguccgcccccucccagucccaggucgcccucguccgcuacgucaaccccgacaccggccgcguccucuucgaggccaagcuccacaagcucggcuucaugaccaucgcccgcaacggcgacucccccaucaccgucccccccaacggcuacuuccgcuucgaguccugggucaaccccuucuacacccucgcccccaugggcaccggcaacggccgccgccgcauccaguga

SEQ ID NO: 15127 - RNA, 1623 nt, Artificial Sequence; identical to SEQ ID NO: 13718
  derived and/or modified sequence opt2 from capsid_protein__Norovirus__BAG68801

SEQ ID NO: 15128 - RNA, 1623 nt, Artificial Sequence
  derived and/or modified sequence opt2 from capsid_protein__Norovirus__BAG68802
augaagauggccuccaacgacgccacccccuccgacggcuccaccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccaacacccagaacuacaccaugaaccucgccucccagaacuggaacaacuacgaccccaccgaggagauccccgccccccucggcacccccgacuucgucggccgcauccagggcguccucacccagaccacccgcggcgacggcuccacccgcggccacaaggccaccgucuccaccggcuccguccacuucacccccaagcucggcuccguccaguucuccaccgacaccuccaacgaccucgagaccggccagaacacccgcuucacccccgucggcgucguccaggacggcggcaccacccaccgcaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15129 - RNA, 1623 nt, Artificial Sequence
  derived and/or modified sequence opt2 from capsid_protein__Norovirus__BAG68803
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15130 - RNA, 1623 nt, Artificial Sequence; identical to SEQ ID NO: 13702
  derived and/or modified sequence opt2 from capsid_protein__Norovirus__BAG68804

SEQ ID NO: 15131 - RNA, 1623 nt, Artificial Sequence
  derived and/or modified sequence opt2 from capsid_protein__Norovirus__BAG68805
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagguccccgccccccucggcacccccgacuucaugggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucucccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15132 - RNA, 1623 nt, Artificial Sequence
  derived and/or modified sequence opt2 from capsid_protein__Norovirus__BAG68806
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuaccucggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15133 - RNA, 1647 nt, Artificial Sequence
  derived and/or modified sequence opt2 from capsid_protein__Norovirus__BAG68807
augaagauggccuccuccgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15134 - RNA, 1623 nt, Artificial Sequence
  derived and/or modified sequence opt2 from capsid_protein__Norovirus__BAG68808
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgacuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgaccucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15135 - RNA, 1623 nt, Artificial Sequence
  derived and/or modified sequence opt2 from capsid_protein__Norovirus__BAG68809
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgacuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgaccucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15136 - RNA, 1623 nt, Artificial Sequence
  derived and/or modified sequence opt2 from capsid_protein__Norovirus__BAG68810
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15137 - RNA, 1623 nt, Artificial Sequence
  derived and/or modified sequence opt2 from capsid_protein__Norovirus__BAG68811
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccaacacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggcggcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15138 - RNA, 1623 nt, Artificial Sequence; identical to SEQ ID NO: 14265
  derived and/or modified sequence opt2 from capsid_protein__Norovirus__BAG68812

SEQ ID NO: 15139 - RNA, 1623 nt, Artificial Sequence
  derived and/or modified sequence opt2 from capsid_protein__Norovirus__BAG68813
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacuccuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccacccccgucgagaagcucuucaccggccccuccuccgccuucaucguccagccccagaacggccgcugcaccaucgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagacccgccagaacacccgcuucacccccgucggcgucauccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcgucauguucgagugcaagcuccacaaguccggcuacaucaccgucgcccacaccggccagcacgaccucgucaucccccccaacggcuacuuccgcuucgacgccugggucaaccaguucuacacccucgcccccaugggcaacggcaccggccgccgccgcgcccucuga

SEQ ID NO: 15140 - RNA, 1647 nt, Artificial Sequence
  derived and/or modified sequence opt2 from capsid_protein__Norovirus__BAG68814
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacaccaccacccgcgcccacgaggccaagaucgacaccaccuccggccgcuucacccccaagcucggcucccucgagaucuccaccgaguccgacgacuucgaccagaacaagcccacccgcuucacccccgucggcaucggcgucgaccgcgaggucgacuuccagcagugggcccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15141 - RNA, 1647 nt, Artificial Sequence
  derived and/or modified sequence opt2 from capsid_protein__Norovirus__BAG68815
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacaccaccacccgcgcccacgaggccaagaucgacaccaccuccggccgcuucacccccaagcucggcucccucgagaucuccaccgaguccgacgacuucgaccagaacaagcccacccgcuucacccccgucggcaucggcgucgaccacgaggucgacuuccagcagugggcccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15142 - RNA, 1623 nt, Artificial Sequence
  derived and/or modified sequence opt2 from capsid_protein__Norovirus__BAG68816
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15143 - RNA, 1626 nt, Artificial Sequence
  derived and/or modified sequence opt2 from capsid_protein__Norovirus__BAH04374
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaagggcgagaagcucaaggucaccaccuucgagaugauccucggccccaccaccaacgucgaccagguccccuaccagggccgcgucuacgccucccucaccgccgccgccucccucgaccucgucgacggccgcguccgcgccgucccccgcuccgucuacggcuuccaggacgucguccccgaguacaacgacggccuccucgucccccucgccccccccaucggccccuuccuccccggcgagguccuccuccgcuuccgcaccuacaugcgccagaucgacuccaccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 15144 - RNA, 1626 nt, Artificial Sequence
  derived and/or modified sequence opt2 from capsid_protein__Norovirus__BAH04377
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaucggcgaggucgccaccuucacccucaucgagcaggacggcuccgccuacguccccggcgaccgcgccgccccccucggcuaccccgacuucuccggccagcucgagaucgagguccagaccgagaccaccaagaagggcgagaagcucaaggucaccaccuucgagaugauccucggccccaccaccaacgucgaccagguccccuaccagggccgcgucuacgccucccucaccgccgccgccucccucgaccucgucgacggccgcguccgcgccgucccccgcuccgucuacggcuuccaggacgucguccccgaguacaacgacggccuccucgucccccucgccccccccaucggccccuuccuccccggcgagguccuccuccgcuuccgcaccuacaugcgccagaucgacuccaccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 15145 - RNA, 1623 nt, Artificial Sequence; identical to SEQ ID NO: 14405
  derived and/or modified sequence opt2 from capsid_protein__Norovirus__BAH29786

SEQ ID NO: 15146 - RNA, 1623 nt, Artificial Sequence
  derived and/or modified sequence opt2 from capsid_protein__Norovirus__BAH30707
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15147 - RNA, 1653 nt, Artificial Sequence
  derived and/or modified sequence opt2 from capsid_protein__Norovirus__BAL40869
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgucgacuccaccgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggcacccaggagcagggccacuacgccacccgcgcccacgaggcccacaucgacaccaccgaccccaaguacgcccccaagcucggcaccauccucaucaaguccgagucccccgacuucaacaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 15148 - RNA, 1644 nt, Artificial Sequence
  derived and/or modified sequence opt2 from capsid_protein__Norovirus__BAL40870
augaagauggccuccuccgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgccccccccaacggcuacuuccgcuucgaggccugggucaaccaguucuacacccucacccccaugggcaccggccagggccgccgccgcaaccaguga

SEQ ID NO: 15149 - RNA, 1644 nt, Artificial Sequence
  derived and/or modified sequence opt2 from capsid_protein__Norovirus__BAL40871
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgacgacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaugguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 15150 - RNA, 1644 nt, Artificial Sequence
  derived and/or modified sequence opt2 from capsid_protein__Norovirus__BAL40872
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccgucggcgccacccgcgcccacgagguccacaucgacaccaccaacccccgcuacacccccaagcucggcuccguccucaugaacuccgaguccuccgacuucgacgacggccagcccaccugcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15151 - RNA, 1644 nt, Artificial Sequence
  derived and/or modified sequence opt2 from capsid_protein__Norovirus__BAL40873
augaagauggccuccaacgacgccgcccccuccaacgacggcgccgccaaccucguccccgaggccaacaacgaggucauggcccucgagcccgucgccggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccgucggcgccacccgcgcccacgagguccacaucgacaccaccaacccccgcuacacccccaagcucggcuccguccucaugcacuccgaguccuccgacuucgacgacggccagcccaucuccuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15152 - RNA, 1626 nt, Artificial Sequence
  derived and/or modified sequence opt2 from capsid_protein__Norovirus__BAL60900
augcgcauguccgacggcgccgcccccaaggccaacggcuccgaggccuccggccaggaccucguccucaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgagcgcgccgccccccucggcuaccccgacuucuccggccagcucgagaucgagguccagaccgagaccaccaagcgcggcgagaagcucaaggucaccaccuucgagaugauccucggccccaccaccaacgucgaccaggcccccuaccagggccgcgucuacgccucccucuccgccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccaggucgacuccuccgacgccgccgccgaggccaucgacugcgcccucccccaggaguucgucuccugguucgccuccaacggcuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgucaccggccgcacccucaagcaguga

SEQ ID NO: 15153 - RNA, 1623 nt, Artificial Sequence
  derived and/or modified sequence opt2 from capsid_protein__Norovirus__BAQ55211
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcaccuccaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccggcgcccaccgcaacgagccccagcaguggguccuccccaacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15154 - RNA, 1623 nt, Artificial Sequence; identical to SEQ ID NO: 13558
  derived and/or modified sequence opt2 from capsid_protein__Norovirus__BAQ55212

SEQ ID NO: 15155 - RNA, 1620 nt, Artificial Sequence
  derived and/or modified sequence opt2 from capsid_protein__Norovirus__BAQ55213
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcaccuccaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgacaccgacaccaacaacgaccucgagaccggccagaacacccgcuucacccccgucggcgucauccaggacggcuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15156 - RNA, 1623 nt, Artificial Sequence
  derived and/or modified sequence opt2 from capsid_protein__Norovirus__BAQ55214
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcaccuccaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccggcgcccaccgcaacgagccccagcaguggguccuccccgacuacuccggcaagaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15157 - RNA, 1620 nt, Artificial Sequence
  derived and/or modified sequence opt2 from capsid_protein__Norovirus__BAQ55215
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgacaccgacaccaacaacgaccucgagaccggccagaacacccgcuucacccccgucggcgucauccaggacggcuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15158 - RNA, 1620 nt, Artificial Sequence
  derived and/or modified sequence opt2 from capsid_protein__Norovirus__BAQ55216
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccagaucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgacaccgacaccaacaacgaccucgagaccggccagaacacccgcuucacccccgucggcgucauccaggacggcuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15159 - RNA, 1620 nt, Artificial Sequence
  derived and/or modified sequence opt2 from capsid_protein__Norovirus__BAQ55217
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcacccacaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccaacaacgacuucgagaccggccagaacacccgcuucacccccgucggcgucauccaggacggcuccgcccaccgcaacgagccccagcaguggguccuccccgacuacuccggcaagaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15160 - RNA, 1623 nt, Artificial Sequence
  derived and/or modified sequence opt2 from capsid_protein__Norovirus__BAQ55218
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccaacacccacaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucaccaccgacaccgacaacgacuucgagaccggccagaacacccgcuucacccccgucggcgucauccaggacggcaacggcgcccaccgcaacgagccccagcaguggguccuccccgacuacuccggcggcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15161 - RNA, 1623 nt, Artificial Sequence; identical to SEQ ID NO: 13771
  derived and/or modified sequence opt2 from capsid_protein__Norovirus__BAR47396

SEQ ID NO: 15162 - RNA, 1623 nt, Artificial Sequence; identical to SEQ ID NO: 14262
  derived and/or modified sequence opt2 from capsid_protein__Norovirus__BAR47397

SEQ ID NO: 15163 - RNA, 1623 nt, Artificial Sequence
  derived and/or modified sequence opt2 from capsid_protein__Norovirus__BAR47398
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgaccagggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15164 - RNA, 1623 nt, Artificial Sequence; identical to SEQ ID NO: 14302
  derived and/or modified sequence opt2 from capsid_protein__Norovirus__BAR47400

SEQ ID NO: 15165 - RNA, 1623 nt, Artificial Sequence
  derived and/or modified sequence opt2 from capsid_protein__Norovirus__BAR47401
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccacccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15166 - RNA, 1623 nt, Artificial Sequence
  derived and/or modified sequence opt2 from capsid_protein__Norovirus__BAR47403
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15167 - RNA, 1623 nt, Artificial Sequence; identical to SEQ ID NO: 13851
  derived and/or modified sequence opt2 from capsid_protein__Norovirus__BAR47404

SEQ ID NO: 15168 - RNA, 1623 nt, Artificial Sequence
  derived and/or modified sequence opt2 from capsid_protein__Norovirus__BAR47405
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15169 - RNA, 1623 nt, Artificial Sequence; identical to SEQ ID NO: 14461
  derived and/or modified sequence opt2 from capsid_protein__Norovirus__BAR47406

SEQ ID NO: 15170 - RNA, 1623 nt, Artificial Sequence
  derived and/or modified sequence opt2 from capsid_protein__Norovirus__BAR47407
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcuccggcaacuacaccaugaaccucgccuccgucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15171 - RNA, 1623 nt, Artificial Sequence
  derived and/or modified sequence opt2 from capsid_protein__Norovirus__BAR47408
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggaucaagaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15172 - RNA, 1623 nt, Artificial Sequence; identical to SEQ ID NO: 14587
  derived and/or modified sequence opt2 from capsid_protein__Norovirus__BAR47410

SEQ ID NO: 15173 - RNA, 1623 nt, Artificial Sequence
  derived and/or modified sequence opt2 from capsid_protein__Norovirus__BAR47412
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcauccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgccuga

SEQ ID NO: 15174 - RNA, 1623 nt, Artificial Sequence
  derived and/or modified sequence opt2 from capsid_protein__Norovirus__BAR47413
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcauccaguucgagaccgacaccgaccacgacuucgaggccaaccagaacaccaaguucacccccgucggcgucauccaggacggcggcaccacccaccgcaacgagccccagcaguggaugcuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgccuga

SEQ ID NO: 15175 - RNA, 1623 nt, Artificial Sequence; identical to SEQ ID NO: 15174
  derived and/or modified sequence opt2 from capsid_protein__Norovirus__BAR47414

SEQ ID NO: 15176 - RNA, 1623 nt, Artificial Sequence; identical to SEQ ID NO: 15174
  derived and/or modified sequence opt2 from capsid_protein__Norovirus__BAR47415

SEQ ID NO: 15177 - RNA, 1623 nt, Artificial Sequence; identical to SEQ ID NO: 14101
  derived and/or modified sequence opt2 from capsid_protein__Norovirus__BAR47417

SEQ ID NO: 15178 - RNA, 1623 nt, Artificial Sequence
  derived and/or modified sequence opt2 from capsid_protein__Norovirus__BAR47418
augaagauggccuccuccgacgccaacccccccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 15179 - RNA, 1623 nt, Artificial Sequence
  derived and/or modified sequence opt2 from capsid_protein__Norovirus__BAR47421
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 15180 - RNA, 1623 nt, Artificial Sequence; identical to SEQ ID NO: 13907
  derived and/or modified sequence opt2 from capsid_protein__Norovirus__BAR47422

SEQ ID NO: 15181 - RNA, 1623 nt, Artificial Sequence
  derived and/or modified sequence opt2 from capsid_protein__Norovirus__BAR47423
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15182 - RNA, 1623 nt, Artificial Sequence; identical to SEQ ID NO: 13909
  derived and/or modified sequence opt2 from capsid_protein__Norovirus__BAR47424

SEQ ID NO: 15183 - RNA, 1623 nt, Artificial Sequence; identical to SEQ ID NO: 14187
  derived and/or modified sequence opt2 from capsid_protein__Norovirus__BAR47426

SEQ ID NO: 15184 - RNA, 1623 nt, Artificial Sequence; identical to SEQ ID NO: 13851
  derived and/or modified sequence opt2 from capsid_protein__Norovirus__BAS53731

SEQ ID NO: 15185 - RNA, 1623 nt, Artificial Sequence
  derived and/or modified sequence opt2 from capsid_protein__Norovirus__BAS53732
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcgccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15186 - RNA, 1623 nt, Artificial Sequence
  derived and/or modified sequence opt2 from capsid_protein__Norovirus__BAS53733
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucuccuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15187 - RNA, 1623 nt, Artificial Sequence
  derived and/or modified sequence opt2 from capsid_protein__Norovirus__BAS53734
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcaguuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15188 - RNA, 1623 nt, Artificial Sequence
  derived and/or modified sequence opt2 from capsid_protein__Norovirus__BAS53945
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucaccacccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15189 - RNA, 1632 nt, Artificial Sequence
  derived and/or modified sequence opt2 from capsid_protein__Norovirus__CAK22261
augaugauggccuccaaggacgccucccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucgucugcugcgucccccccggcuuccagucccgcacccucuccaucgcccaggccacccucuucccccacaucaucgccgacguccgcacccucgagcccaucgagaucccccucgaggacguccgcaacacccucuaccacaccaacgacaaccagcccaccaugcgccuccucugcaugcucuacaccccccuccgcaccggcggcggcuccggcggcaccgacgccuucgucgucgccggccgcguccucaccugccccuccuccgacuucaacuuccucuuccucgucccccccaccgucgagcagaagacccgccccuucuccguccccaacaucccccuccagcuccucuccaacucccgcguccccaaccucauccaguccaugguccucucccccgaccaggcccagaacguccaguuccagaacggccgcugcaccaccgacggccagcuccucggcaccacccccgucuccgucucccagauccucaaguuccgcggcaaggucuccgccggcucccgcgucaucaaccucaccgagcucgacggcucccccuuccucgccuucgaggcccccgcccccaccggcuuccccgaccucggcaccuccgacuggcacgucgagaugucccucaacuccaacucccaguccuccggcaaccccauccuccuccgcgacauccagcccaacuccuccgacuucgucccccaccucggcuccgucgccgucaccaccgccaucgacgucgccggcgacuacaccggcaccauccaguggaccucccagcccuccaacgucacccccguccccgacgucaacuucuggaccaucccccaguacggcuccaaccucgccgaggccucccagcucgcccccgucgucuacccccccggcuucggcgaggccaucgucuacuucaugucccccauccccggccccaacaccgcccacaagcccaaccucguccccugccuccucccccaggaguucgucacccacuucgucuccgagcaggcccccuccaugggcgaggccgcccucguccacuacgucgaccccgacaccaaccgcaaccucggcgaguucaagcucuaccccgagggcuucaucaccugcguccccaacggcaccggcccccagcagcucccccucaacggcgucuucgucuucgccuccugggucucccgcuucuaccagcucaagcccgucggcaccgccuccuccgcccgcggccgccucggcguccgccgcuga

SEQ ID NO: 15190 - RNA, 1671 nt, Artificial Sequence
  derived and/or modified sequence opt2 from capsid_protein__Norovirus__CAR95870
augaagauggccuccuccgacgccgcccccuccaccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccuccgaggccgacgagcgcgccgucggcuccuucgacgucuggguccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcaccggccacaucuccgccaacaaguacugggaguucaaguccuucggcgucgagggcgagcgccacaccaacauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcggccgcguccgcuuccaguga

SEQ ID NO: 15191 - RNA, 1623 nt, Artificial Sequence; identical to SEQ ID NO: 14337
  derived and/or modified sequence opt2 from capsid_protein_VP1__Norovirus__ADB27914

SEQ ID NO: 15192 - RNA, 1623 nt, Artificial Sequence; identical to SEQ ID NO: 13235
  derived and/or modified sequence opt2 from capsid_protein_VP1__Norovirus__ADI45809

SEQ ID NO: 15193 - RNA, 1623 nt, Artificial Sequence; identical to SEQ ID NO: 13792
  derived and/or modified sequence opt2 from capsid_protein_VP1__Norovirus__ADI45810

SEQ ID NO: 15194 - RNA, 1623 nt, Artificial Sequence; identical to SEQ ID NO: 13236
  derived and/or modified sequence opt2 from capsid_protein_VP1__Norovirus__ADI45813

SEQ ID NO: 15195 - RNA, 1608 nt, Artificial Sequence; identical to SEQ ID NO: 13458
  derived and/or modified sequence opt2 from capsid_protein_VP1__Norovirus__ADT70684

SEQ ID NO: 15196 - RNA, 1608 nt, Artificial Sequence; identical to SEQ ID NO: 13737
  derived and/or modified sequence opt2 from capsid_protein_VP1__Norovirus__ADZ24003

SEQ ID NO: 15197 - RNA, 1623 nt, Artificial Sequence; identical to SEQ ID NO: 13456
  derived and/or modified sequence opt2 from capsid_protein_VP1__Norovirus__AFI08234

SEQ ID NO: 15198 - RNA, 1623 nt, Artificial Sequence; identical to SEQ ID NO: 13245
  derived and/or modified sequence opt2 from capsid_protein_VP1__Norovirus__AFI08237

SEQ ID NO: 15199 - RNA, 1623 nt, Artificial Sequence; identical to SEQ ID NO: 13280
  derived and/or modified sequence opt2 from capsid_protein_VP1__Norovirus__AFI08243

SEQ ID NO: 15200 - RNA, 1593 nt, Artificial Sequence; identical to SEQ ID NO: 13393
  derived and/or modified sequence opt2 from capsid_protein_VP1__Norovirus__AFJ38516

SEQ ID NO: 15201 - RNA, 1620 nt, Artificial Sequence; identical to SEQ ID NO: 13686
  derived and/or modified sequence opt2 from capsid_protein_VP1__Norovirus__AFJ38519

SEQ ID NO: 15202 - RNA, 1623 nt, Artificial Sequence; identical to SEQ ID NO: 13250
  derived and/or modified sequence opt2 from capsid_protein_VP1__Norovirus__AFW15937

SEQ ID NO: 15203 - RNA, 1623 nt, Artificial Sequence; identical to SEQ ID NO: 13249
  derived and/or modified sequence opt2 from capsid_protein_VP1__Norovirus__AFW15939

SEQ ID NO: 15204 - RNA, 1623 nt, Artificial Sequence; identical to SEQ ID NO: 13851
  derived and/or modified sequence opt2 from capsid_protein_VP1__Norovirus__AFW15942

SEQ ID NO: 15205 - RNA, 1623 nt, Artificial Sequence; identical to SEQ ID NO: 13251
  derived and/or modified sequence opt2 from capsid_protein_VP1__Norovirus__AFW15943

SEQ ID NO: 15206 - RNA, 1623 nt, Artificial Sequence; identical to SEQ ID NO: 13252
  derived and/or modified sequence opt2 from capsid_protein_VP1__Norovirus__AFW15946

SEQ ID NO: 15207 - RNA, 1647 nt, Artificial Sequence; identical to SEQ ID NO: 13835
  derived and/or modified sequence opt2 from capsid_protein_VP1__Norovirus__AFX71656

SEQ ID NO: 15208 - RNA, 1629 nt, Artificial Sequence; identical to SEQ ID NO: 13833
  derived and/or modified sequence opt2 from capsid_protein_VP1__Norovirus__AFX71659

SEQ ID NO: 15209 - RNA, 1623 nt, Artificial Sequence; identical to SEQ ID NO: 13278
  derived and/or modified sequence opt2 from capsid_protein_VP1__Norovirus__AFX81124

SEQ ID NO: 15210 - RNA, 1623 nt, Artificial Sequence; identical to SEQ ID NO: 13299
  derived and/or modified sequence opt2 from capsid_protein_VP1__Norovirus__AFX81133

SEQ ID NO: 15211 - RNA, 1623 nt, Artificial Sequence; identical to SEQ ID NO: 13447
  derived and/or modified sequence opt2 from capsid_protein_VP1__Norovirus__AFX81151

SEQ ID NO: 15212 - RNA, 1623 nt, Artificial Sequence; identical to SEQ ID NO: 13498
  derived and/or modified sequence opt2 from capsid_protein_VP1__Norovirus__AFX81160

SEQ ID NO: 15213 - RNA, 1623 nt, Artificial Sequence; identical to SEQ ID NO: 13380
  derived and/or modified sequence opt2 from capsid_protein_VP1__Norovirus__AFX81175

SEQ ID NO: 15214 - RNA, 1623 nt, Artificial Sequence; identical to SEQ ID NO: 13295
  derived and/or modified sequence opt2 from capsid_protein_VP1__Norovirus__AFX81184

SEQ ID NO: 15215 - RNA, 1623 nt, Artificial Sequence; identical to SEQ ID NO: 13332
  derived and/or modified sequence opt2 from capsid_protein_VP1__Norovirus__AFX81187

SEQ ID NO: 15216 - RNA, 1623 nt, Artificial Sequence; identical to SEQ ID NO: 13539
  derived and/or modified sequence opt2 from capsid_protein_VP1__Norovirus__AFX81217

SEQ ID NO: 15217 - RNA, 1623 nt, Artificial Sequence; identical to SEQ ID NO: 13529
  derived and/or modified sequence opt2 from capsid_protein_VP1__Norovirus__AFX81220

SEQ ID NO: 15218 - RNA, 1623 nt, Artificial Sequence; identical to SEQ ID NO: 13351
  derived and/or modified sequence opt2 from capsid_protein_VP1__Norovirus__AFX81223

SEQ ID NO: 15219 - RNA, 1623 nt, Artificial Sequence; identical to SEQ ID NO: 13288
  derived and/or modified sequence opt2 from capsid_protein_VP1__Norovirus__AFX81235

SEQ ID NO: 15220 - RNA, 1623 nt, Artificial Sequence; identical to SEQ ID NO: 13330
  derived and/or modified sequence opt2 from capsid_protein_VP1__Norovirus__AFX81259

SEQ ID NO: 15221 - RNA, 1623 nt, Artificial Sequence; identical to SEQ ID NO: 13319
  derived and/or modified sequence opt2 from capsid_protein_VP1__Norovirus__AFX81280

SEQ ID NO: 15222 - RNA, 1623 nt, Artificial Sequence; identical to SEQ ID NO: 13471
  derived and/or modified sequence opt2 from capsid_protein_VP1__Norovirus__AFX81286

SEQ ID NO: 15223 - RNA, 1623 nt, Artificial Sequence; identical to SEQ ID NO: 13327
  derived and/or modified sequence opt2 from capsid_protein_VP1__Norovirus__AFX81310

SEQ ID NO: 15224 - RNA, 1623 nt, Artificial Sequence; identical to SEQ ID NO: 13548
  derived and/or modified sequence opt2 from capsid_protein_VP1__Norovirus__AGE89469

SEQ ID NO: 15225 - RNA, 1623 nt, Artificial Sequence; identical to SEQ ID NO: 13512
  derived and/or modified sequence opt2 from capsid_protein_VP1__Norovirus__AGE89484

SEQ ID NO: 15226 - RNA, 1623 nt, Artificial Sequence; identical to SEQ ID NO: 13349
  derived and/or modified sequence opt2 from capsid_protein_VP1__Norovirus__AGE89487

SEQ ID NO: 15227 - RNA, 1623 nt, Artificial Sequence; identical to SEQ ID NO: 13385
  derived and/or modified sequence opt2 from capsid_protein_VP1__Norovirus__AGE89619

SEQ ID NO: 15228 - RNA, 1623 nt, Artificial Sequence; identical to SEQ ID NO: 13494
  derived and/or modified sequence opt2 from capsid_protein_VP1__Norovirus__AGE89670

SEQ ID NO: 15229 - RNA, 1623 nt, Artificial Sequence; identical to SEQ ID NO: 13388
  derived and/or modified sequence opt2 from capsid_protein_VP1__Norovirus__AGE99596

SEQ ID NO: 15230 - RNA, 1653 nt, Artificial Sequence; identical to SEQ ID NO: 13831
  derived and/or modified sequence opt2 from capsid_protein_VP1__Norovirus__AGE99599

SEQ ID NO: 15231 - RNA, 1620 nt, Artificial Sequence; identical to SEQ ID NO: 13635
  derived and/or modified sequence opt2 from capsid_protein_VP1__Norovirus__AGE99612

SEQ ID NO: 15232 - RNA, 1647 nt, Artificial Sequence; identical to SEQ ID NO: 13836
  derived and/or modified sequence opt2 from capsid_protein_VP1__Norovirus__AGI17609

SEQ ID NO: 15233 - RNA, 1593 nt, Artificial Sequence; identical to SEQ ID NO: 13394
  derived and/or modified sequence opt2 from capsid_protein_VP1__Norovirus__AGM33211

SEQ ID NO: 15234 - RNA, 1593 nt, Artificial Sequence; identical to SEQ ID NO: 13399
  derived and/or modified sequence opt2 from capsid_protein_VP1__Norovirus__AGM33223

SEQ ID NO: 15235 - RNA, 1623 nt, Artificial Sequence; identical to SEQ ID NO: 13429
  derived and/or modified sequence opt2 from capsid_protein_VP1__Norovirus__AGT17839

SEQ ID NO: 15236 - RNA, 1617 nt, Artificial Sequence; identical to SEQ ID NO: 13428
  derived and/or modified sequence opt2 from capsid_protein_VP1__Norovirus__AGX85910

SEQ ID NO: 15237 - RNA, 1623 nt, Artificial Sequence; identical to SEQ ID NO: 13899
  derived and/or modified sequence opt2 from capsid_protein_VP1__Norovirus__AHI59162

SEQ ID NO: 15238 - RNA, 1620 nt, Artificial Sequence; identical to SEQ ID NO: 13856
  derived and/or modified sequence opt2 from capsid_protein_VP1__Norovirus__AHI59165

SEQ ID NO: 15239 - RNA, 1623 nt, Artificial Sequence; identical to SEQ ID NO: 13445
  derived and/or modified sequence opt2 from capsid_protein_VP1__Norovirus__AHX22044

SEQ ID NO: 15240 - RNA, 1623 nt, Artificial Sequence; identical to SEQ ID NO: 13478
  derived and/or modified sequence opt2 from capsid_protein_VP1__Norovirus__AII02587

SEQ ID NO: 15241 - RNA, 1647 nt, Artificial Sequence; identical to SEQ ID NO: 13463
  derived and/or modified sequence opt2 from capsid_protein_VP1__Norovirus__AII02617

SEQ ID NO: 15242 - RNA, 1647 nt, Artificial Sequence; identical to SEQ ID NO: 13551
  derived and/or modified sequence opt2 from capsid_protein_VP1__Norovirus__AIS24556

SEQ ID NO: 15243 - RNA, 1623 nt, Artificial Sequence; identical to SEQ ID NO: 13728
  derived and/or modified sequence opt2 from capsid_protein_VP1__Norovirus__BAI49908

SEQ ID NO: 15244 - RNA, 1623 nt, Artificial Sequence; identical to SEQ ID NO: 13565
  derived and/or modified sequence opt2 from capsid_protein_VP1__Norovirus__BAI49913

SEQ ID NO: 15245 - RNA, 1623 nt, Artificial Sequence; identical to SEQ ID NO: 13572
  derived and/or modified sequence opt2 from capsid_protein_VP1__Norovirus__BAI49922

SEQ ID NO: 15246 - RNA, 1608 nt, Artificial Sequence; identical to SEQ ID NO: 13580
  derived and/or modified sequence opt2 from capsid_protein_VP1__Norovirus__BAJ25074

SEQ ID NO: 15247 - RNA, 1617 nt, Artificial Sequence; identical to SEQ ID NO: 13590
  derived and/or modified sequence opt2 from capsid_protein_VP1__Norovirus__BAP33934

SEQ ID NO: 15248 - RNA, 1623 nt, Artificial Sequence
  derived and/or modified sequence opt2 from major_capsid_protein__Norovirus__ABQ63283
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccaucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccgucaacuucacccccaagcucggccgcauccaguucuccaccgacaccuccaacgacuucgagaccggccaguccacccgcuucacccccgucggcgucguccaggacggcuccaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15249 - RNA, 1623 nt, Artificial Sequence
  derived and/or modified sequence opt2 from major_capsid_protein__Norovirus__ABV55634
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaaguggaacaaguacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucuccaccgacaccgagaacgacuucgagacccaccagaacaccaaguucacccccgucggcgucacccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15250 - RNA, 1623 nt, Artificial Sequence
  derived and/or modified sequence opt2 from major_capsid_protein__Norovirus__ACV41093
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacugguccaacuacgaccccaccgaggagauccccgccccccucggcacccccgacuucgucggcaagauccagggcaugcucacccagaccaccggccgcgacggcuccacccgcggccacaaggccaccguccucaccggcuccgccgacuucgcccccaagcucggccgcguccaguucgccaccgacaccgacaacgacuucgaguccggcgagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15251 - RNA, 1635 nt, Artificial Sequence
  derived and/or modified sequence opt2 from major_capsid_protein__Norovirus__ACV41096
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagcgcguccucaaccucaccgagcucgacggcucccccuucauggccuucgccgcccccgcccccgccggcuuccccgaccucggcuccugcgacuggcacaucgagauguccaagauccccaacuccuccacccagaacaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucggcguccgccgcuga

SEQ ID NO: 15252 - RNA, 1743 nt, Artificial Sequence
  derived and/or modified sequence opt2 from major_capsid_protein__Norovirus__ACV88130
augaagauggccuccaacgacgccaccgcccccucccaggacggcgccgccaaccucguccccgagucccagcacgagguccucgcccucgagcccgucgccggcgccgcccucgccgcccccgucgccggccaguucaacgccaucgaccccuggaucaagcagaacuucguccaggcccccgccggcgaguucaccgucuccccccgcaacgcccccggcgagauccucauggaccucgagcucggccccgagcucucccccuuccucgcccaccucgcccagauguacaacgccuacgccggcggcauggagguccagaucauccucgccggcaacgccuucaccgccggcaagaucaucgucugcgccgucccccccaacuucccccccgaccgccucuccgccucccaggccaccaacuucccccacgucaucauggacguccgcacccucgagcccgucauccucccccuccccgacguccgcgccggcuucuuccacuacaaccagcuccgcgagccccgcaugcgccucauggcccuccucuacaccccccuccgcgccaacggcaccggcgacgacgccuucaccgucuccugccgcguccucacccgccccaugcaggacuucgaguucauguuccucgucccccccaccgucgagucccgcgucacccccuucuccguccccaccuaccccgucgucgagaugaccaacucccgcuggcccgcccgcaucuccggcaugcacgucaacgccaaccagacccucgccguccaguuccagaacggccgcugcacccucgacggccagcucaugggcaccacccagcucugcgccgccgacgucugccgcaugcgcggccgcuacaccuccacccgcgccgaccucgccggcgucgaccacaccgaccagggccccucccucggcgccggccccuccaacgaccccgucuccguccccgaggcccgcucccagacccgcaccuccgucuccgcccaccuccagcucgaggagcucaacggccagcccuacgaggucuacggcgagcagcccgccccccucggcacccccgacuucugcugccgccucaugggcgagcucguccgccuccccuccaccucccccgccgcccagucccgcuuccgcgacgccuucuucgacaccuacggcgcccucuucgcccccgccgucggcuccaccaccuucaccgucaacaacuccuccaccuccgacuucgccaacggccagcccuucgaguuccuccccaucggcgucgagaucggcaacuccgcccaguacgacgaguucgcccuccccuccuacaacggcgccaucggcgagaaccgccaccucgcccccgucgccgcccccggcuuccccggcgagaacaucgucuucuucuccuccaaccuccccgucugggacuccaccuccgcccagaacaaccgccgcaucuccugccuccuccccaacgaguucguccagcacuucuacgaccuccaggcccccucccaguccgacgucgcccuccuccgcuacguccaccccgaguccggccgcguccucuucgagugcaagcucuaccgcgacggcuuccucaccgucaacggcgccucccucgccgaguuccccgucaacggcuacuuccgcuucgacuccugggucaaccaguucuucacccucucccccgucggcaccggcuccggccgcuccggccgcucccgcaacgcccaguga

SEQ ID NO: 15253 - RNA, 1623 nt, Artificial Sequence; identical to SEQ ID NO: 14399
  derived and/or modified sequence opt2 from major_capsid_protein__Norovirus__ACW19927

SEQ ID NO: 15254 - RNA, 1623 nt, Artificial Sequence
  derived and/or modified sequence opt2 from major_capsid_protein__Norovirus__ACX31885
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15255 - RNA, 1623 nt, Artificial Sequence
  derived and/or modified sequence opt2 from major_capsid_protein__Norovirus__ACX31887
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccaacuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucauccccuccaacggcuacuuccgcuucgacuccugggucaaccaguucuacacccucgcccccaugggcaacggcaccggccgccgccgcgcccucuga

SEQ ID NO: 15256 - RNA, 1623 nt, Artificial Sequence
  derived and/or modified sequence opt2 from major_capsid_protein__Norovirus__ACX31891
augaagauggccuccuccgacgccucccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcggcgacggcuccacccgcggccacaaggccaccgucuacaccggcuccgccgacuucgcccccaagcucggccgcguccaguucgccaccgacaccgacaacgacuucgaguccaaccagaacaccaaguucacccccgucggcgucauccaggacggcaacaccacccaccagaacgagccccagcaguggguccuccccggcuacuccggccgcgacggccacaacguccaccucgcccccgccgucgcccccaccuaccccggcgagcagcuccucuucuuccgcuccaccaugcccggcugcuccggcuaccccaacaugaaccucgacugccuccucccccaggaguggguccagcacuucuaccaggaggccgcccccgcccaguccgaggucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15257 - RNA, 1623 nt, Artificial Sequence
  derived and/or modified sequence opt2 from major_capsid_protein__Norovirus__ACZ37232
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucgucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgagaugauguacaccgcccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaccaacgagcccaaccccgccacccgcgcccacgaggccaacaucaacaccggcggcgaccaguacgcccccaagcucgcccaggucaaguucuucuccgagucccaggacuucgagguccaccagcccaccgucuucacccccgucggcgucgccggcgacaccucccaccccuuccgccaguggguccucccccgcuacggcggccaccucaccaacaacacccaccucgcccccgccgucgccccccucuuccccggcgagcagauccucuucuuccgcucccagauccccuccuccggcggccacgagcucggcuacauggacugccucgucccccaggaguggguccagcacuucuaccaggaggccgccaccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcauccaguga

SEQ ID NO: 15258 - RNA, 1623 nt, Artificial Sequence; identical to SEQ ID NO: 13252
  derived and/or modified sequence opt2 from major_capsid_protein__Norovirus__ADD10375

SEQ ID NO: 15259 - RNA, 1623 nt, Artificial Sequence
  derived and/or modified sequence opt2 from major_capsid_protein__Norovirus__ADO85552
augaagauggccuccuccgacgccaaccccuccgacggcuccaccgccaaccucguccccgaggucaacaacgaggucauggcccucgagcccgucgucggcgccgccuccgccgcccccgucgccggccagcagaacgucaucgaccccuggauccgcaacaacuucguccaggcccccggcggcgaguucaccgagucccccaccaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucguccccgccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgcccccgucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15260 - RNA, 1623 nt, Artificial Sequence
  derived and/or modified sequence opt2 from major_capsid_protein__Norovirus__ADQ43779
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcagugggcccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15261 - RNA, 1623 nt, Artificial Sequence; identical to SEQ ID NO: 13292
  derived and/or modified sequence opt2 from major_capsid_protein__Norovirus__ADQ43781

SEQ ID NO: 15262 - RNA, 1623 nt, Artificial Sequence; identical to SEQ ID NO: 13792
  derived and/or modified sequence opt2 from major_capsid_protein__Norovirus__ADQ43783

SEQ ID NO: 15263 - RNA, 1623 nt, Artificial Sequence; identical to SEQ ID NO: 13792
  derived and/or modified sequence opt2 from major_capsid_protein__Norovirus__ADV37805

SEQ ID NO: 15264 - RNA, 1623 nt, Artificial Sequence; identical to SEQ ID NO: 13792
  derived and/or modified sequence opt2 from major_capsid_protein__Norovirus__ADV37807

SEQ ID NO: 15265 - RNA, 1623 nt, Artificial Sequence; identical to SEQ ID NO: 13792
  derived and/or modified sequence opt2 from major_capsid_protein__Norovirus__ADV37809

SEQ ID NO: 15266 - RNA, 1623 nt, Artificial Sequence
  derived and/or modified sequence opt2 from major_capsid_protein__Norovirus__ADV37813
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgaccucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15267 - RNA, 1623 nt, Artificial Sequence
  derived and/or modified sequence opt2 from major_capsid_protein__Norovirus__ADV37917
augaagauggccuccuccgacaccaagaccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaucgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15268 - RNA, 1623 nt, Artificial Sequence
  derived and/or modified sequence opt2 from major_capsid_protein__Norovirus__ADV37919
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaucgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15269 - RNA, 1608 nt, Artificial Sequence
  derived and/or modified sequence opt2 from major_capsid_protein__Norovirus__AEI83469
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggaggacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuuccgcucccacaucucccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 15270 - RNA, 1644 nt, Artificial Sequence
  derived and/or modified sequence opt2 from major_capsid_protein__Norovirus__AEP04093
augaagauggccuccaacgacgccgcccccuccaccgacggcuccgccggccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggagguccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccucccucacccucgacgagcucuccaacucccgcuuccccgcccccaucguccagcucuacaccaacccccacgacaaccucgucguccagccccagaacggccgcugcaccaucgacggccuccuccagggcaccacccagcucgucuccugcaacgucugcuccuuccgcggcaccaucggcgacggccagcccgccucccacuccgaggaggagaucaugcccauggccuucaacauccagcgcgagcucaugcucgagaaccucgacggcucccccuacgaccccaccgacgacauccccgccguccucggcucccccgacuuccagggcgucaucuucggcauccucucccagcgcaacggcgacggccagacccgcgcccacgaggccaaggucgacacccgcgccgcccgcuucgcccccaagcucggcuucgucgucgccaccgucgaguccaccgacuuccacgccaaccagcccucccgcuucacccccgucggccucggcggcgacggcaaccaggacuucgcccaguggaaccuccccaccuacggcggcgcccucaccaacaacaccaaccucgccccccccgucaugcccgucuaccccggcgagcagcuccucuucuuccgcucccagcuccccuccuccggcggcgucgucggcggcuggcucgacugccuccucccccaggaguggguccagcacuucuuccaggaguccgccaccucccaguccgacgucgcccucguccgcuacaucaaccccaccaccggccgcguccucuucgaggccaagcuccacaagcagggcuuccucaccgucgccgccuccggcuccuacccccucgucguccccgccgacggcuacuuccgcuucgaguccugggucaaccaguucuacacccucgcccccaugggcaacggcuccggccgccgccgcacccgcuga

SEQ ID NO: 15271 - RNA, 1620 nt, Artificial Sequence
  derived and/or modified sequence opt2 from major_capsid_protein__Norovirus__AEQ77282
augaugauggccuccaaggacgcccccuccaacauggacggcaccuccggcgccggccagcucguccccgaggucaacgccgccgagccccucccccucgagcccgucgucggcgccgccaccgccgccgccaccgccggccaggucaaccucaucgaccccuggaucaugaacaacuucguccaggcccccgagggcgaguucaccaucucccccaacaacacccccggcgacauccucuucgaccuccaccucggcccccaccucaaccccuuccuccagcaccucucccagauguacaacggcugggucggcaacaugcgcguccgcgucaugcucgccggcaacgccuucaccgccggcaagaucaucaucugcugcgucccccccggcuucgccucccagaacaucuccaucggccaggccaccauguucccccacgucaucgccgacguccgcguccucgagcccaucgagaucccccucgacgacguccgcaacguccucuuccacaccaacgagaaccgccccaccaugcgccuccucugcaugcucuacaccccccuccgcgccggcggcgccuccuccggcaccgaccccuucgucaucgccggccgcguccucaccugccccucccccgacuucaacuuccucuuccucgucccccccuccgucgagcagaagacccgccagcucaccguccccaacaucccccucaacaaccucgccaacucccgcguccccgccaugaucaacaagaugaccgucuccaccgaccagaaccaggucguccaguuccagaacggccgcugcacccucgagggccagcuccucggcaccacccccgucuccgccucccaggucgcccgcauccgcggcaaggucuucuccaccgccuccggcaagggccucaaccucaccgagcucgacggcacccccuaccacgccuucgagucccccgccccccucggcuuccccgacaucggcgccugcgacuggcacgucuccaccuucaaggucgaccagaaccucuccggcgaccccaugucccgccucgacgucaagcagaacgcccccuucgccccccaccucggcuccaucgaguucaccuccgaccaggaccccaccggcgaccagcucggcacccucgccugggucucccccuccaccuccggcgcccgcgucgaccccuggaagauccccuccuacggcuccaccgucaccgaguccacccaccucgccccccccaucuucccccccggcuucggcgaggccaucgucuacuucauguccgacuuccccaucgucuccggcaacaccgcccagguccccugcacccucccccaggaguucgucucccacuucgucgagcagcaggcccccguccgcggcgaggccgcccuccuccacuacgucgaccccgacacccaccgcaaccucggcgaguucaagcucuaccccgacggcuucaucaccugcguccccaacaccggcggcggcccccagaaccuccccaccaacggcgucuucgucuucuccuccugggucucccgcuacuaccagcucaagcccgucggcaccgccggccccgcccgccgccucggcguccgccgcgucuga

SEQ ID NO: 15272 - RNA, 1608 nt, Artificial Sequence
  derived and/or modified sequence opt2 from major_capsid_protein__Norovirus__AFA55174
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagguccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuucccccucgagaaccucucccccggccagaucaccauguucccccacgucaucaucgacguccgcacccucgagcccguccuccucccccuccccgacguccgcaacaacuucuuccacuacaaccagcagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccguccccaucgacgagcucuacaccucccccaacgagggcgucgucguccagccccagaacggccgcuccacccucgacggcgagcuccucggcaccacccagcucguccccuccaacaucugcgcccuccgcggccgcaucaacgcccagguccccgacgaccaccaccaguggaaccuccaggucaccaacgccaacggcaccuccuucgaccccaccgaggacguccccgccccccucggcacccccgacuuccucgccaacaucuacggcgucaccucccagcgcaaccccgacaacaccugccgcgcccacgacggcguccucgccaccuggucccccaaguucacccccaagcucggcuccgucguccucggcaccugggaggaguccgaccucgaccucaaccagcccacccgcuucacccccgucggccucuacgacaccggccacuucgaccaguggguccuccccaacuacuccggccgccucacccucaacaugaaccucgcccccuccgucgccccccucuuccccggcgagcagauccucuucuuccgcucccacaucccccucaagggcggcaccuccaacggcgccaucgacugccuccucccccaggaguggauccagcacuucuaccaggaguccgcccccucccccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 15273 - RNA, 1629 nt, Artificial Sequence
  derived and/or modified sequence opt2 from major_capsid_protein__Norovirus__AFC89656
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccaucuccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaacguccuccagcucaccuaccccuccggcgccuccuacgaccccaccgacgagguccccgccccccucggcacccaggacuucuccggcauccucuacggcguccucacccaggacaacguccgcgagaacaccggcgaggccaagaacgccaagggcgucuacaucuccaccaccuccggcaaguucacccccaagaucggcuccaucggccuccacuccaucaccgaggacguccgccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcguccaguga

SEQ ID NO: 15274 - RNA, 1617 nt, Artificial Sequence
  derived and/or modified sequence opt2 from major_capsid_protein__Norovirus__AFC89659
augaugauggccuccaaggacgcccccuccaacauggacggcaccuccggcgccggccagcucguccccgaggucaacaccgccgagccccucccccucgagcccgucgucggcgccgccaccgccgccgccaccgccggccaggucaaccucaucgaccccuggaucaugaacaacuucguccaggcccccgagggcgaguucaccaucucccccaacaacacccccggcgacauccucuucgaccuccgccucggcccccaccucaaccccuuccuccuccaccucucccagauguacaacggcugggucggcaacaugcgcauccgcgucaugcucgccggcaacgccuucuccgccggcaagaucaucaucugcugcgucccccccggcuucgagucccagaacaucuccaucggccaggccaccauguucccccacgucaucgccgacguccgcguccucgagcccaucgagaucccccucgacgacguccgcaacguccucuaccacaccaacgagaaccgccccaccaugcgccuccucugcaugcucuacaccccccuccgcgccggcggcgccuccuccggcaccgaccccuucgucaucgccggccgcguccucaccugccccgcccccgacuucaacuuccucuuccucgucccccccuccgucgagcagaagacccgccagcucaccauccccaacaucccccucaacaaccucgccaacucccgcguccccgccaugaucaacaagauggccgucuccgccgaccagaaccaggucguccaguuccagaacggccgcugcacccucgagggccagcuccucggcaccacccccgucuccgccaaccaggucgcccgcauccgcggcaaggucuucuccaccaacuccggcaccggccucaaccucaccgagaccgacggcacccccuaccacgccuucgagucccccgccccccucggcuuccccgacaucggcgacugcgacuggcacgucuacgccuucaaggucaaccagaacaccggcgaccccauguaccgccucgacaucacccagggcaacuccuucgccccccaccucggcuccaucgaguucaccuccgaccagcaccccuccggcgaccagcucggcacccucaccuggaucuccccccucaacaacgccucccgcgucgaccccuggaagauccccuccuacggcuccacccucaccgaguccaccaaccucgccccccccaucuucccccccggcuucggcgaggccaucgucuacuucauguccgacuuccccaucgucuccggcaacaccacccagauccccugcacccucccccaggaguucaucuccuccuucgucgagcagcaggcccccauccgcggcgaggccgcccuccuccacuacgucgaccccgacacccaccgcaaccucggcgaguucaagcucuaccccgacggcuucaucaccugcguccccaacaccggcggcggcccccagaaccuccccuccaacggcgucuucaucuucuccuccugggucucccgcuacuaccagcucaagcccgucggcaccgccggccccgcccgccgccucggcguccgccgcaucuga

SEQ ID NO: 15275 - RNA, 1647 nt, Artificial Sequence
  derived and/or modified sequence opt2 from major_capsid_protein__Norovirus__AFC89662
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaccgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaagaucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15276 - RNA, 1620 nt, Artificial Sequence
  derived and/or modified sequence opt2 from major_capsid_protein__Norovirus__AFC89665
augaagauggccuccaacgacgccgcccccuccaacgacggcgccaccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaugaccuccaaccccaccuccgacuacugggacgaccaccuccuccaccucguccaccccaacggcgccaccuacgaccccaccgaggacguccccgcccccuucggcacccaggacuuccgcggcauccucuacggcaugcucacccagaacccccgcaccuccggcgacgaggccgccaacucccacggcaucuacaucuccuccaccuccgagaaguucacccccaagcucggcaccaucggccuccaccagguccagggcgacaucgccuccaaccagcaguccaaguucacccccgucggcaucgccgucaacggcaacacccccuuccgccagugggagcuccccaacuacuccggcgcccucacccucaacaccaaccucgcccccgccgucggccccaacuuccccggcgagcagauccucuucuuccgcuccaacguccccuccguccagggcggccagcccaucgagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcguccaguga

SEQ ID NO: 15277 - RNA, 1623 nt, Artificial Sequence; identical to SEQ ID NO: 13702
  derived and/or modified sequence opt2 from major_capsid_protein__Norovirus__AFC89667

SEQ ID NO: 15278 - RNA, 1626 nt, Artificial Sequence
  derived and/or modified sequence opt2 from major_capsid_protein__Norovirus__AFD62272
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggccaggucgccaccuucaccaugaucgagcaggacggcuccgccuacguccccggcgaccgcgccgccccccucggcuaccccgacuacuccggccagcucgagaucgagguccagaccgagaccaccaaggccggcgacaagcucaaggucaccaccuucgagaugauccucggccccaccaccaacgucgaccaggcccccuaccagggccgcgccuacgccucccucaccgccgccgccucccucgaccucgucgacggccgcguccgcgccgucccccgcuccaucuacuccuuccaggacguccuccccgaguacaacgacggccuccucgucccccucgcccccccccucggccccuuccuccccggcgagguccuccuccgcuuccgcaccuacaugcgccagcucgacaccgccgacgccgccgcccagcccaucgacugcgcccucccccaggaguucgucuccugguucgccuccaacuccuucaccguccaguccgacgcccuccucguccgcuaccgcaacacccucaccggccagcuccucuucgaggccaagcucuacuccgagggcuacaucgccgucuccuacuccggcuccggcccccucaccuuccccgccgacggcuucuucgaggucgucuccugggucccccgccucuuccagcucgccuccgucggcucccucgccaccggccgcacccucaagcaguga

SEQ ID NO: 15279 - RNA, 1620 nt, Artificial Sequence
  derived and/or modified sequence opt2 from major_capsid_protein__Norovirus__AFJ04707
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacaucacccacaucgccggcucccacgacuacaccaugaaccucgccucccagaacugguccaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcggcaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 15280 - RNA, 1623 nt, Artificial Sequence
  derived and/or modified sequence opt2 from major_capsid_protein__Norovirus__AFJ04708
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15281 - RNA, 1623 nt, Artificial Sequence
  derived and/or modified sequence opt2 from major_capsid_protein__Norovirus__AFJ04709
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggcggccgccgcgcccucuga

SEQ ID NO: 15282 - RNA, 1623 nt, Artificial Sequence
  derived and/or modified sequence opt2 from major_capsid_protein__Norovirus__AFP89593
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucauccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcguccucuga

SEQ ID NO: 15283 - RNA, 1623 nt, Artificial Sequence
  derived and/or modified sequence opt2 from major_capsid_protein__Norovirus__AFU55686
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgaggccggccagaacaccaaguucacccccgacggcgucguccaggacggcaacggcacccaccagaacgagccccagcaguggguccuccccuccuacuccggccgcaccggccacaacguccaccucgcccccgccaucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15284 - RNA, 1623 nt, Artificial Sequence
  derived and/or modified sequence opt2 from major_capsid_protein__Norovirus__AFU55689
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcgcccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgaccucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15285 - RNA, 1623 nt, Artificial Sequence
  derived and/or modified sequence opt2 from major_capsid_protein__Norovirus__AFU55692
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15286 - RNA, 1623 nt, Artificial Sequence; identical to SEQ ID NO: 13715
  derived and/or modified sequence opt2 from major_capsid_protein__Norovirus__AFU55695

SEQ ID NO: 15287 - RNA, 1623 nt, Artificial Sequence
  derived and/or modified sequence opt2 from major_capsid_protein__Norovirus__AFU55698
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccucggcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15288 - RNA, 1623 nt, Artificial Sequence; identical to SEQ ID NO: 14265
  derived and/or modified sequence opt2 from major_capsid_protein__Norovirus__AFU55701

SEQ ID NO: 15289 - RNA, 1623 nt, Artificial Sequence; identical to SEQ ID NO: 14354
  derived and/or modified sequence opt2 from major_capsid_protein__Norovirus__AFU55704

SEQ ID NO: 15290 - RNA, 1623 nt, Artificial Sequence
  derived and/or modified sequence opt2 from major_capsid_protein__Norovirus__AFU55707
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccgagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15291 - RNA, 1623 nt, Artificial Sequence; identical to SEQ ID NO: 13761
  derived and/or modified sequence opt2 from major_capsid_protein__Norovirus__AFU55710

SEQ ID NO: 15292 - RNA, 1623 nt, Artificial Sequence
  derived and/or modified sequence opt2 from major_capsid_protein__Norovirus__AFU55713
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15293 - RNA, 1623 nt, Artificial Sequence
  derived and/or modified sequence opt2 from major_capsid_protein__Norovirus__AFU55716
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucaucaucccccccaacggcuacuuccgcuucgacuccugggucaaccaguucuacacccucgcccccaugggcaacggcaccggccgccgccgcgcccucuga

SEQ ID NO: 15294 - RNA, 1623 nt, Artificial Sequence; identical to SEQ ID NO: 14337
  derived and/or modified sequence opt2 from major_capsid_protein__Norovirus__AFU55719

SEQ ID NO: 15295 - RNA, 1623 nt, Artificial Sequence; identical to SEQ ID NO: 13252
  derived and/or modified sequence opt2 from major_capsid_protein__Norovirus__AFU55722

SEQ ID NO: 15296 - RNA, 1623 nt, Artificial Sequence
  derived and/or modified sequence opt2 from major_capsid_protein__Norovirus__AFU55725
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccgacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15297 - RNA, 1623 nt, Artificial Sequence
  derived and/or modified sequence opt2 from major_capsid_protein__Norovirus__AFU55728
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15298 - RNA, 1623 nt, Artificial Sequence
  derived and/or modified sequence opt2 from major_capsid_protein__Norovirus__AFU55731
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagguccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15299 - RNA, 1623 nt, Artificial Sequence; identical to SEQ ID NO: 13292
  derived and/or modified sequence opt2 from major_capsid_protein__Norovirus__AFU55734

SEQ ID NO: 15300 - RNA, 1623 nt, Artificial Sequence; identical to SEQ ID NO: 13292
  derived and/or modified sequence opt2 from major_capsid_protein__Norovirus__AFU55737

SEQ ID NO: 15301 - RNA, 1623 nt, Artificial Sequence
  derived and/or modified sequence opt2 from major_capsid_protein__Norovirus__AFU92659
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucauccccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaguccuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15302 - RNA, 1623 nt, Artificial Sequence
  derived and/or modified sequence opt2 from major_capsid_protein__Norovirus__AFU92660
augaagauggccuccaacgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15303 - RNA, 1623 nt, Artificial Sequence
  derived and/or modified sequence opt2 from major_capsid_protein__Norovirus__AFU92661
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugccacgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggccgcauccagggcguccucacccagaccacccgccgcgacggcuccacccgcggccacaaggccacccucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15304 - RNA, 1623 nt, Artificial Sequence
  derived and/or modified sequence opt2 from major_capsid_protein__Norovirus__AFU92662
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggcacgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccauccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15305 - RNA, 1623 nt, Artificial Sequence
  derived and/or modified sequence opt2 from major_capsid_protein__Norovirus__AFU92663
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucaccaacaucgccggcucccagaccuacaccaugaaccucgccucccagaacuggaacaacuacgaccccaccgaggagauccccgccccccucggcacccccgacuucgucggccgcauccagggcguccucacccagaccacccgcggcgacggcuccacccgcggccacaaggccaccgucuccaccggcuccgccuacuucacccccaagcucggcuccguccaguucuccaccgacaccuccaccgacuucgagaccggccagaacacccgcuucacccccgucggcgucguccaggacggcuccaccacccacaagaacgagccccagcaguggguccuccccuccuacuccggccgcgacucccacaacguccaccucgcccccgccgucgcccccaccuuccccggcgagcagauccucuucuuccgcuccaccaugcccggcugcuccggcuaccccaacauggaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15306 - RNA, 1623 nt, Artificial Sequence
  derived and/or modified sequence opt2 from major_capsid_protein__Norovirus__AFU92664
augaagauggccuccaacgacgccaaccccuccgacggcuccgccgcccaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15307 - RNA, 1623 nt, Artificial Sequence
  derived and/or modified sequence opt2 from major_capsid_protein__Norovirus__AFU92666
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccucgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagacccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15308 - RNA, 1623 nt, Artificial Sequence
  derived and/or modified sequence opt2 from major_capsid_protein__Norovirus__AFU92667
augaagauggccuccaacgacgccacccccuccgacggcgucgccgcccaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15309 - RNA, 1623 nt, Artificial Sequence
  derived and/or modified sequence opt2 from major_capsid_protein__Norovirus__AFU92668
augaagauggccuccaacgacgucacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15310 - RNA, 1623 nt, Artificial Sequence; identical to SEQ ID NO: 14320
  derived and/or modified sequence opt2 from major_capsid_protein__Norovirus__AFU92669

SEQ ID NO: 15311 - RNA, 1623 nt, Artificial Sequence
  derived and/or modified sequence opt2 from major_capsid_protein__Norovirus__AFU92670
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggcgcgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15312 - RNA, 1623 nt, Artificial Sequence
  derived and/or modified sequence opt2 from major_capsid_protein__Norovirus__AFU92671
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15313 - RNA, 1623 nt, Artificial Sequence
  derived and/or modified sequence opt2 from major_capsid_protein__Norovirus__AFU92672
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagacccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15314 - RNA, 1623 nt, Artificial Sequence
  derived and/or modified sequence opt2 from major_capsid_protein__Norovirus__AFU92673
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgccguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15315 - RNA, 1623 nt, Artificial Sequence
  derived and/or modified sequence opt2 from major_capsid_protein__Norovirus__AFU92674
augaagauggccuccaacgacgcccaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaccaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15316 - RNA, 1623 nt, Artificial Sequence
  derived and/or modified sequence opt2 from major_capsid_protein__Norovirus__AFU92676
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccaccucccgcgacggcuccacccgcggccacaaggccaccgucuccaccggcuccguccacuucacccccaagcucggccgcguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15317 - RNA, 1623 nt, Artificial Sequence
  derived and/or modified sequence opt2 from major_capsid_protein__Norovirus__AFU92677
augaagauggccuccaacgacgcccaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15318 - RNA, 1623 nt, Artificial Sequence
  derived and/or modified sequence opt2 from major_capsid_protein__Norovirus__AFU92678
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguacgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15319 - RNA, 1623 nt, Artificial Sequence
  derived and/or modified sequence opt2 from major_capsid_protein__Norovirus__AFU92679
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgaguucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15320 - RNA, 1623 nt, Artificial Sequence; identical to SEQ ID NO: 14320
  derived and/or modified sequence opt2 from major_capsid_protein__Norovirus__AFU92680

SEQ ID NO: 15321 - RNA, 1623 nt, Artificial Sequence; identical to SEQ ID NO: 13715
  derived and/or modified sequence opt2 from major_capsid_protein__Norovirus__AFU92681

SEQ ID NO: 15322 - RNA, 1623 nt, Artificial Sequence; identical to SEQ ID NO: 13715
  derived and/or modified sequence opt2 from major_capsid_protein__Norovirus__AFU92682

SEQ ID NO: 15323 - RNA, 1623 nt, Artificial Sequence; identical to SEQ ID NO: 14399
  derived and/or modified sequence opt2 from major_capsid_protein__Norovirus__AFU92684

SEQ ID NO: 15324 - RNA, 1623 nt, Artificial Sequence
  derived and/or modified sequence opt2 from major_capsid_protein__Norovirus__AFU92685
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucgcccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15325 - RNA, 1623 nt, Artificial Sequence
  derived and/or modified sequence opt2 from major_capsid_protein__Norovirus__AFU92686
augaagauggccuccaacgacgcccaccccuccgacggcuccgccgccacccucguccccaaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagcuccacguccuccucgccggcaacgccuucaccgccggcaagaucaucaucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaucuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15326 - RNA, 1623 nt, Artificial Sequence
  derived and/or modified sequence opt2 from major_capsid_protein__Norovirus__AFU92687
augaagauggccuccaacgaccccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15327 - RNA, 1623 nt, Artificial Sequence
  derived and/or modified sequence opt2 from major_capsid_protein__Norovirus__AFU92688
augaagauggccuccaacgacgcccaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcccccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15328 - RNA, 1623 nt, Artificial Sequence; identical to SEQ ID NO: 13742
  derived and/or modified sequence opt2 from major_capsid_protein__Norovirus__AFU92689

SEQ ID NO: 15329 - RNA, 1623 nt, Artificial Sequence; identical to SEQ ID NO: 13742
  derived and/or modified sequence opt2 from major_capsid_protein__Norovirus__AFU92690

SEQ ID NO: 15330 - RNA, 1623 nt, Artificial Sequence; identical to SEQ ID NO: 13742
  derived and/or modified sequence opt2 from major_capsid_protein__Norovirus__AFU92691

SEQ ID NO: 15331 - RNA, 1623 nt, Artificial Sequence; identical to SEQ ID NO: 14399
  derived and/or modified sequence opt2 from major_capsid_protein__Norovirus__AFU92692

SEQ ID NO: 15332 - RNA, 1623 nt, Artificial Sequence
  derived and/or modified sequence opt2 from major_capsid_protein__Norovirus__AFU92693
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15333 - RNA, 1623 nt, Artificial Sequence; identical to SEQ ID NO: 13792
  derived and/or modified sequence opt2 from major_capsid_protein__Norovirus__AFU92694

SEQ ID NO: 15334 - RNA, 1623 nt, Artificial Sequence; identical to SEQ ID NO: 13851
  derived and/or modified sequence opt2 from major_capsid_protein__Norovirus__AFU92695

SEQ ID NO: 15335 - RNA, 1623 nt, Artificial Sequence; identical to SEQ ID NO: 14377
  derived and/or modified sequence opt2 from major_capsid_protein__Norovirus__AFU92696

SEQ ID NO: 15336 - RNA, 1623 nt, Artificial Sequence; identical to SEQ ID NO: 13851
  derived and/or modified sequence opt2 from major_capsid_protein__Norovirus__AFU92697

SEQ ID NO: 15337 - RNA, 1623 nt, Artificial Sequence; identical to SEQ ID NO: 13702
  derived and/or modified sequence opt2 from major_capsid_protein__Norovirus__AFU92698

SEQ ID NO: 15338 - RNA, 1623 nt, Artificial Sequence
  derived and/or modified sequence opt2 from major_capsid_protein__Norovirus__AFU92699
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucauccucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccgccgcaacgagccccagcaguggguccuccccuccuacuccggccgcaacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15339 - RNA, 1623 nt, Artificial Sequence
  derived and/or modified sequence opt2 from major_capsid_protein__Norovirus__AFU92700
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15340 - RNA, 1623 nt, Artificial Sequence; identical to SEQ ID NO: 13851
  derived and/or modified sequence opt2 from major_capsid_protein__Norovirus__AFU92701

SEQ ID NO: 15341 - RNA, 1623 nt, Artificial Sequence; identical to SEQ ID NO: 13792
  derived and/or modified sequence opt2 from major_capsid_protein__Norovirus__AFU92702

SEQ ID NO: 15342 - RNA, 1623 nt, Artificial Sequence
  derived and/or modified sequence opt2 from major_capsid_protein__Norovirus__AFU92703
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15343 - RNA, 1623 nt, Artificial Sequence
  derived and/or modified sequence opt2 from major_capsid_protein__Norovirus__AFU92704
augaagauggccuccuccgacgccaaccccuccgacggcuccaccgcccaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15344 - RNA, 1623 nt, Artificial Sequence; identical to SEQ ID NO: 13702
  derived and/or modified sequence opt2 from major_capsid_protein__Norovirus__AFU92705

SEQ ID NO: 15345 - RNA, 1623 nt, Artificial Sequence; identical to SEQ ID NO: 13292
  derived and/or modified sequence opt2 from major_capsid_protein__Norovirus__AFU92706

SEQ ID NO: 15346 - RNA, 1623 nt, Artificial Sequence
  derived and/or modified sequence opt2 from major_capsid_protein__Norovirus__AFU92707
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcgucgaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15347 - RNA, 1623 nt, Artificial Sequence
  derived and/or modified sequence opt2 from major_capsid_protein__Norovirus__AFU92708
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacaugaaccucgacugccucaucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15348 - RNA, 1623 nt, Artificial Sequence; identical to SEQ ID NO: 13292
  derived and/or modified sequence opt2 from major_capsid_protein__Norovirus__AFU92709

SEQ ID NO: 15349 - RNA, 1623 nt, Artificial Sequence; identical to SEQ ID NO: 13292
  derived and/or modified sequence opt2 from major_capsid_protein__Norovirus__AFU92710

SEQ ID NO: 15350 - RNA, 1623 nt, Artificial Sequence; identical to SEQ ID NO: 13292
  derived and/or modified sequence opt2 from major_capsid_protein__Norovirus__AFU92711

SEQ ID NO: 15351 - RNA, 1623 nt, Artificial Sequence
  derived and/or modified sequence opt2 from major_capsid_protein__Norovirus__AFU92712
augaagauggccuccaacgacgccaaccccuccgagggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcaccauccgcugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuucuccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagucccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccucaucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15352 - RNA, 1623 nt, Artificial Sequence
  derived and/or modified sequence opt2 from major_capsid_protein__Norovirus__AFU92713
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuucuccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15353 - RNA, 1623 nt, Artificial Sequence; identical to SEQ ID NO: 13292
  derived and/or modified sequence opt2 from major_capsid_protein__Norovirus__AFU92714

SEQ ID NO: 15354 - RNA, 1623 nt, Artificial Sequence
  derived and/or modified sequence opt2 from major_capsid_protein__Norovirus__AFU92715
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuucuccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15355 - RNA, 1623 nt, Artificial Sequence
  derived and/or modified sequence opt2 from major_capsid_protein__Norovirus__AFU92717
augaagauggccuccuccgaccccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaagcucaagcuccgccccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15356 - RNA, 1623 nt, Artificial Sequence
  derived and/or modified sequence opt2 from major_capsid_protein__Norovirus__AFU92718
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccucgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15357 - RNA, 1623 nt, Artificial Sequence; identical to SEQ ID NO: 13851
  derived and/or modified sequence opt2 from major_capsid_protein__Norovirus__AFU92719

SEQ ID NO: 15358 - RNA, 1623 nt, Artificial Sequence
  derived and/or modified sequence opt2 from major_capsid_protein__Norovirus__AFU92720
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15359 - RNA, 1623 nt, Artificial Sequence
  derived and/or modified sequence opt2 from major_capsid_protein__Norovirus__AFU92721
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15360 - RNA, 1623 nt, Artificial Sequence
  derived and/or modified sequence opt2 from major_capsid_protein__Norovirus__AFU92722
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15361 - RNA, 1623 nt, Artificial Sequence
  derived and/or modified sequence opt2 from major_capsid_protein__Norovirus__AFU92723
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15362 - RNA, 1647 nt, Artificial Sequence
  derived and/or modified sequence opt2 from major_capsid_protein__Norovirus__AGD79474
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccgcgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcguccaguga

SEQ ID NO: 15363 - RNA, 1647 nt, Artificial Sequence
  derived and/or modified sequence opt2 from major_capsid_protein__Norovirus__AGD79475
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucauccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgucaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccgcgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15364 - RNA, 1647 nt, Artificial Sequence
  derived and/or modified sequence opt2 from major_capsid_protein__Norovirus__AGD79476
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacaccaccacccgcgcccacgaggccaaggucgacaccaccuccggccgcuucacccccaagcucggcucccucgagaucuccaccgaguccgacgacuucgaccagaacaagcccacccgcuucacccccgucggcaucggcgucgaccacgaggccgacuuccagcaguggacccuccccgacuacgccggccaguucacccacaacaugaaccucgcccccgccgucguccccaacuuccccggcgagcagcuccucuucuuccgcucccagcuccccuccuccggcggccgcuccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15365 - RNA, 1647 nt, Artificial Sequence
  derived and/or modified sequence opt2 from major_capsid_protein__Norovirus__AGD79477
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacaccuccacccgcgcccacgaggccaagaucgacaccaccuccggccgcuucacccccaagcucggcucccucgagaucuccaccgaguccgacgacuucgaccagaacaagcccacccgcuucacccccgucggcaucggcgucgaccacgagaccgacuuccagcaguggacccuccccgacuacgccggccagcucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15366 - RNA, 1647 nt, Artificial Sequence
  derived and/or modified sequence opt2 from major_capsid_protein__Norovirus__AGD79478
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacgagacccccuacgaccccgccgagggcauccccggcccccucggcacccccgacuuccgcggcaaggucuucggcgucgccucccagcgcaaccccgacaccaccacccgcgcccacgaggccaaggucgacaccaccuccggccgcuucacccccaagcucggcucccucgagaucuccaccgaguccgacgacuucgaccagaacaagcccacccgcuucacccccgucggcaucggcgucgaccacgaggccgacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaucaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15367 - RNA, 1647 nt, Artificial Sequence
  derived and/or modified sequence opt2 from major_capsid_protein__Norovirus__AGD79479
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacaccaccacccgcgcccacgaggccaaggucgacaccaccuccggccgcuucacccccaagcucggcucccucgagaucuccaccgaguccgacgacuucgaccagaacaagcccacccgcuucacccccgucggcaucggcgucgaccacgaggccgacuuccagcaguggacccuccccgacuacgccggccaguucacccacaacaugaaccucgcccccgccgucgcccccaacuuccccggcgagcagcuccucuucuuccgcucccagcuccccuccuccggcggccgcaccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaucaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15368 - RNA, 1620 nt, Artificial Sequence
  derived and/or modified sequence opt2 from major_capsid_protein__Norovirus__AGH24750
augaagauggccuccaacgacaccauccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccaugccccucucccccgaccucaaccccuaccucucccaccucucccgcauguacaacggcuacgccggcggcuucgagguccaggucauccucgccggcaacgccuucaccgccggcaagaucaucuucgccgccaucccccccaacuuccccaccgacggccucucccccucccaggucaccauguucccccacaucaucgucgacguccgccagcucgagcccguccucaucccccuccccgacguccgcaacaacuucuaccacuacaaccaggucaacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgacgagaugaccaacucccgcuuccccaccccccucgagcgccuccacaccggccccaacaacucccucgucguccagccccagaacggccgcugcaccaucgacggcguccuccucggcaccacccagcucuccgccgucaacaucugcuccuuccgcggcgacuccaccacccgcgagggccagucccacgccuacaccaugaaccucgccucccagaacuggaccaacuacgaccccaccgaggacauccccgccccccucggcacccccgacuucgucggcaagaucgucggcaugcucucccagaccacccgcgagaacuccuccacccgcgcccacaaggccaccgucuccaccggcgacgcccacuucaugcccaagcucggcuccguccucuucaccaccgacaccgaggaccuccagaacggccagaacacccgcuucacccccgucggcgucgcccaggacggcgagccccaccagaacgagccccagcaguggcgccuccccaacuacuccggcacccccggccacaacguccaccucgccccccccgucgcccccaccuuccccggcgagcagcuccucuucuuccgcuccaccaugcccggcugcggcggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaaggccggcuacaucaccgucucccacaccggccccuacgaccucgucaucccccccaacggcuacuuccgcuucgacuccugggucaaccaguucuacgcccucgcccccaugggcaccggcaccggccgccgccgcgcccucuga

SEQ ID NO: 15369 - RNA, 1623 nt, Artificial Sequence; identical to SEQ ID NO: 13792
  derived and/or modified sequence opt2 from major_capsid_protein__Norovirus__AGI37922

SEQ ID NO: 15370 - RNA, 1623 nt, Artificial Sequence
  derived and/or modified sequence opt2 from major_capsid_protein__Norovirus__AGM46344
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15371 - RNA, 1623 nt, Artificial Sequence
  derived and/or modified sequence opt2 from major_capsid_protein__Norovirus__AGM46347
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15372 - RNA, 1623 nt, Artificial Sequence; identical to SEQ ID NO: 13292
  derived and/or modified sequence opt2 from major_capsid_protein__Norovirus__AGM46349

SEQ ID NO: 15373 - RNA, 1623 nt, Artificial Sequence; identical to SEQ ID NO: 13292
  derived and/or modified sequence opt2 from major_capsid_protein__Norovirus__AGM46355

SEQ ID NO: 15374 - RNA, 1623 nt, Artificial Sequence
  derived and/or modified sequence opt2 from major_capsid_protein__Norovirus__AGM46359
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccuccucccgcaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgacaccgacaccgacaacgacuucgagaccaaccagaacaccaaguucacccccgucggcgucauccaggacggcuccaccaccuaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15375 - RNA, 1623 nt, Artificial Sequence
  derived and/or modified sequence opt2 from major_capsid_protein__Norovirus__AGM46362
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccuccucccgcaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgacaccgacaccgacaacgacuucgagaccaaccagaacaccaaguucacccccgucggcgucauccaggacggcuccaccaccuaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15376 - RNA, 1623 nt, Artificial Sequence
  derived and/or modified sequence opt2 from major_capsid_protein__Norovirus__AGM46366
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggcucccgccgcgcccucuga

SEQ ID NO: 15377 - RNA, 1623 nt, Artificial Sequence; identical to SEQ ID NO: 13292
  derived and/or modified sequence opt2 from major_capsid_protein__Norovirus__AGM46367

SEQ ID NO: 15378 - RNA, 1623 nt, Artificial Sequence
  derived and/or modified sequence opt2 from major_capsid_protein__Norovirus__AGM46370
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15379 - RNA, 1623 nt, Artificial Sequence; identical to SEQ ID NO: 15378
  derived and/or modified sequence opt2 from major_capsid_protein__Norovirus__AGM46375

SEQ ID NO: 15380 - RNA, 1623 nt, Artificial Sequence
  derived and/or modified sequence opt2 from major_capsid_protein__Norovirus__AGM46377
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15381 - RNA, 1623 nt, Artificial Sequence; identical to SEQ ID NO: 15378
  derived and/or modified sequence opt2 from major_capsid_protein__Norovirus__AGM46379

SEQ ID NO: 15382 - RNA, 1623 nt, Artificial Sequence; identical to SEQ ID NO: 15378
  derived and/or modified sequence opt2 from major_capsid_protein__Norovirus__AGM46384

SEQ ID NO: 15383 - RNA, 1623 nt, Artificial Sequence
  derived and/or modified sequence opt2 from major_capsid_protein__Norovirus__AGM46386
augaagaugggcuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15384 - RNA, 1623 nt, Artificial Sequence
  derived and/or modified sequence opt2 from major_capsid_protein__Norovirus__AGM46388
augaagaugggcuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15385 - RNA, 1623 nt, Artificial Sequence
  derived and/or modified sequence opt2 from major_capsid_protein__Norovirus__AGM46392
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaucgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcaguuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15386 - RNA, 1623 nt, Artificial Sequence; identical to SEQ ID NO: 13792
  derived and/or modified sequence opt2 from major_capsid_protein__Norovirus__AGM46395

SEQ ID NO: 15387 - RNA, 1623 nt, Artificial Sequence
  derived and/or modified sequence opt2 from major_capsid_protein__Norovirus__AGM46398
augaagauggccuccuccgacgccaaccccuccgacggcuccaaggccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggcucccgccgcgcccucuga

SEQ ID NO: 15388 - RNA, 1623 nt, Artificial Sequence; identical to SEQ ID NO: 13292
  derived and/or modified sequence opt2 from major_capsid_protein__Norovirus__AGM46401

SEQ ID NO: 15389 - RNA, 1623 nt, Artificial Sequence; identical to SEQ ID NO: 13292
  derived and/or modified sequence opt2 from major_capsid_protein__Norovirus__AGM46403

SEQ ID NO: 15390 - RNA, 1623 nt, Artificial Sequence
  derived and/or modified sequence opt2 from major_capsid_protein__Norovirus__AGM46407
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccucccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15391 - RNA, 1623 nt, Artificial Sequence
  derived and/or modified sequence opt2 from major_capsid_protein__Norovirus__AGM46409
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15392 - RNA, 1623 nt, Artificial Sequence; identical to SEQ ID NO: 14412
  derived and/or modified sequence opt2 from major_capsid_protein__Norovirus__AGM46413

SEQ ID NO: 15393 - RNA, 1623 nt, Artificial Sequence
  derived and/or modified sequence opt2 from major_capsid_protein__Norovirus__AGM46415
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15394 - RNA, 1623 nt, Artificial Sequence
  derived and/or modified sequence opt2 from major_capsid_protein__Norovirus__AGM46419
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcauccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15395 - RNA, 1623 nt, Artificial Sequence
  derived and/or modified sequence opt2 from major_capsid_protein__Norovirus__AGM46421
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15396 - RNA, 1623 nt, Artificial Sequence
  derived and/or modified sequence opt2 from major_capsid_protein__Norovirus__AGM46425
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgucuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacgcccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15397 - RNA, 1623 nt, Artificial Sequence
  derived and/or modified sequence opt2 from major_capsid_protein__Norovirus__AGM46427
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucccccccgucaacaucugcaccuuccgcggcgacgucacccacaucgccggcucccgcgucuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacgcccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15398 - RNA, 1623 nt, Artificial Sequence; identical to SEQ ID NO: 14516
  derived and/or modified sequence opt2 from major_capsid_protein__Norovirus__AGM46431

SEQ ID NO: 15399 - RNA, 1671 nt, Artificial Sequence
  derived and/or modified sequence opt2 from major_capsid_protein__Norovirus__AGN11430
augaagauggccuccuccgacgccgcccccuccaccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgaggucgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccucccccgaggccgacgagcgcgccgucggcuccuucgacgucuggguccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccaacuacgcccccgccaccggcaacaugcgcuucaccguccgcaacggcggcaccggccacaccuccgccaacaaguacugggaguucaaguccuucggcgucgagggcgagcgccacaccggcauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcggccgcguccgcuuccaguga

SEQ ID NO: 15400 - RNA, 1647 nt, Artificial Sequence
  derived and/or modified sequence opt2 from major_capsid_protein__Norovirus__AGO64038
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgaccccaagcuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcaccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15401 - RNA, 1623 nt, Artificial Sequence
  derived and/or modified sequence opt2 from major_capsid_protein__Norovirus__AGO64040
augaagauggccuccaacgacgccgcccccuccaacgacggcgccgccggccucguccccgagaucaacaacgaggucaugccccucgagcccgucgccggcgccucccccgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuucccccacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucaucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgagaugauguacaccgcccgcaacgagaaccaggucguccagccccagaacggccgcgucacccucgacggcgagcuccucggcaccaccccccuccucggcaucgacaucugcaaguucaagggcgaggucaucgccaagaaccgcgacgaccgcuccuaccgcauggacauggagaucaccaacaccgacggcacccccaucgaccccaccgaggacacccccggccccaucggcucccccgacuuccgcggcauccucuucggcgucgccucccagcgcaacaagaacgagcagaaccccgccacccgcggccacgaggccaacaucaacaccggcggcaaccaguacgcccccaagcucgcccaggucaaguucuucuccgaguccgacgacuucgacgagcaccagcccaccgucuucacccccgucggcgucgccggcgacgacucccaccccuuccgccaguggguccucccccgcuacggcggccaccucaccaacaacacccaccucgcccccgccgucgccccccucuuccccggcgagcagauccucuucuuccgcucccagauccccuccuccggcggcuucgagcucggcuacauggacugccucgucccccaggaguggguccagcacuucuaccaggaggccgccaccgcccaguccgacgucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcguccaguga

SEQ ID NO: 15402 - RNA, 1608 nt, Artificial Sequence
  derived and/or modified sequence opt2 from major_capsid_protein__Norovirus__AGO64042
augaagauggccuccaacgacgccgcccccuccaacgacggcgccgccggccucguccccgaggccaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacuccuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaugggcgagcucaccaacucccgcuuccccguccccaucgacgagcucuacaccucccccaacgagaaccucgucguccagccccagaacggccgcugcgcccucgacggcgagcuccagggcaccacccagcuccuccccaccgccaucugcuccuuccgcggccgcgucaaccagaaggucuccggcgagaaccacgucuggaacaugcaggucaccaacaucaacggcacccccuucgaccccaccgaggacguccccgccccccucggcacccccgacuucuccggccgccucuucggcguccucucccagcgcgaccacgacaacgccugccgcucccacgacgccgucaucgccaccaacuccaccaaguucacccccaagcucggcgccauccagaucggcaccugggaggaggacgacguccacaucaaccagcccaccaaguucacccccgucggccucuucgacaccgacgacuucaaccagugggcccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcaaccgccccaucgucguccccgccaacggcuacuuccgcuucgacuccugggucaaccaguucuacucccucgcccccaugggcaccggcaacggccgccgccgcguccaguga

SEQ ID NO: 15403 - RNA, 1623 nt, Artificial Sequence
  derived and/or modified sequence opt2 from major_capsid_protein__Norovirus__AGS41450
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacaccgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15404 - RNA, 1623 nt, Artificial Sequence
  derived and/or modified sequence opt2 from major_capsid_protein__Norovirus__AGT62521
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccguccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccaggaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccggcaacucccagcucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 15405 - RNA, 1629 nt, Artificial Sequence
  derived and/or modified sequence opt2 from major_capsid_protein__Norovirus__AGT62523
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcaccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagauguccaacucccgcuuccccguccccaucgaccagauguacaccucccccaacgaggucaucuccguccagugccagaacggccgcugcacccucgacggcgagcuccagggcaccacccagcuccaggucuccggcaucugcgccuucaagggccaggucaccgcccaccuccaggacaacgagcaccucuacaacgucaccaucaccaaccucaacggcucccccuucgaccccuccgaggacauccccgccccccucggcguccccgacuucgagggccgcgucuucggcgucaucucccagcgcgacaacuacaacuccggcggccagaaccagcccgccaaccgcucccacgacgccgucguccccaccuacaccgcccaguacacccccaagcucggccagauccagaucggcaccuggcagaccgacgacaucaccgucgaccagcccgccaaguucacccccgucggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuucggcaaccccgccaucgacugccucgucccccaggaguggauccagcacuucuaccaggaggccgcccccucccucuccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15406 - RNA, 1623 nt, Artificial Sequence; identical to SEQ ID NO: 14610
  derived and/or modified sequence opt2 from major_capsid_protein__Norovirus__AGV40221

SEQ ID NO: 15407 - RNA, 1623 nt, Artificial Sequence
  derived and/or modified sequence opt2 from major_capsid_protein__Norovirus__AGV76553
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacuccggccagcacgaccucgucaucccccccaacggcuacuuccgcuucgacuccugggucaaccaguucuacacccucgcccccaugggcaacggcaccggccgccgccgcgcccucuga

SEQ ID NO: 15408 - RNA, 1623 nt, Artificial Sequence; identical to SEQ ID NO: 13911
  derived and/or modified sequence opt2 from major_capsid_protein__Norovirus__AGV76554

SEQ ID NO: 15409 - RNA, 1623 nt, Artificial Sequence; identical to SEQ ID NO: 13911
  derived and/or modified sequence opt2 from major_capsid_protein__Norovirus__AGV76555

SEQ ID NO: 15410 - RNA, 1623 nt, Artificial Sequence; identical to SEQ ID NO: 13911
  derived and/or modified sequence opt2 from major_capsid_protein__Norovirus__AGV76556

SEQ ID NO: 15411 - RNA, 1623 nt, Artificial Sequence; identical to SEQ ID NO: 13911
  derived and/or modified sequence opt2 from major_capsid_protein__Norovirus__AGV76557

SEQ ID NO: 15412 - RNA, 1623 nt, Artificial Sequence; identical to SEQ ID NO: 13911
  derived and/or modified sequence opt2 from major_capsid_protein__Norovirus__AGV76558

SEQ ID NO: 15413 - RNA, 1623 nt, Artificial Sequence; identical to SEQ ID NO: 13911
  derived and/or modified sequence opt2 from major_capsid_protein__Norovirus__AGV76559

SEQ ID NO: 15414 - RNA, 1623 nt, Artificial Sequence; identical to SEQ ID NO: 13911
  derived and/or modified sequence opt2 from major_capsid_protein__Norovirus__AGV76560

SEQ ID NO: 15415 - RNA, 1623 nt, Artificial Sequence; identical to SEQ ID NO: 13911
  derived and/or modified sequence opt2 from major_capsid_protein__Norovirus__AGV76561

SEQ ID NO: 15416 - RNA, 1623 nt, Artificial Sequence; identical to SEQ ID NO: 13911
  derived and/or modified sequence opt2 from major_capsid_protein__Norovirus__AGV76562

SEQ ID NO: 15417 - RNA, 1623 nt, Artificial Sequence; identical to SEQ ID NO: 13911
  derived and/or modified sequence opt2 from major_capsid_protein__Norovirus__AGV76563

SEQ ID NO: 15418 - RNA, 1623 nt, Artificial Sequence
  derived and/or modified sequence opt2 from major_capsid_protein__Norovirus__AGV76564
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccuccauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15419 - RNA, 1623 nt, Artificial Sequence; identical to SEQ ID NO: 13911
  derived and/or modified sequence opt2 from major_capsid_protein__Norovirus__AGV76565

SEQ ID NO: 15420 - RNA, 1623 nt, Artificial Sequence; identical to SEQ ID NO: 13911
  derived and/or modified sequence opt2 from major_capsid_protein__Norovirus__AGV76566

SEQ ID NO: 15421 - RNA, 1623 nt, Artificial Sequence
  derived and/or modified sequence opt2 from major_capsid_protein__Norovirus__AGV76567
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucggcaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15422 - RNA, 1623 nt, Artificial Sequence
  derived and/or modified sequence opt2 from major_capsid_protein__Norovirus__AGV76568
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucaucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15423 - RNA, 1623 nt, Artificial Sequence; identical to SEQ ID NO: 13911
  derived and/or modified sequence opt2 from major_capsid_protein__Norovirus__AGV76569

SEQ ID NO: 15424 - RNA, 1623 nt, Artificial Sequence; identical to SEQ ID NO: 13911
  derived and/or modified sequence opt2 from major_capsid_protein__Norovirus__AGV76570

SEQ ID NO: 15425 - RNA, 1623 nt, Artificial Sequence
  derived and/or modified sequence opt2 from major_capsid_protein__Norovirus__AGV76571
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaucaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15426 - RNA, 1623 nt, Artificial Sequence
  derived and/or modified sequence opt2 from major_capsid_protein__Norovirus__AGV76572
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccuccgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 15427 - RNA, 1623 nt, Artificial Sequence; identical to SEQ ID NO: 13909
  derived and/or modified sequence opt2 from major_capsid_protein__Norovirus__AGV76573

SEQ ID NO: 15428 - RNA, 1623 nt, Artificial Sequence
  derived and/or modified sequence opt2 from major_capsid_protein__Norovirus__AGV76574
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccucaucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 15429 - RNA, 1623 nt, Artificial Sequence
  derived and/or modified sequence opt2 from major_capsid_protein__Norovirus__AGV76575
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgacaacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccucaucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 15430 - RNA, 1623 nt, Artificial Sequence; identical to SEQ ID NO: 13909
  derived and/or modified sequence opt2 from major_capsid_protein__Norovirus__AHA44844

SEQ ID NO: 15431 - RNA, 1623 nt, Artificial Sequence
  derived and/or modified sequence opt2 from major_capsid_protein__Norovirus__AHA44847
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcgccgacggcuccacccgcggccacaaggccaucgucuacaccggcuccgccgacuucgcccccaagcucggccgcguccaguucgagaccgacaccgaccacgacuucgaggccaaccagaacaccaaguucacccccgucggcgucacccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 15432 - RNA, 1623 nt, Artificial Sequence
  derived and/or modified sequence opt2 from major_capsid_protein__Norovirus__AHB62404
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcuccuccaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcgccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15433 - RNA, 1623 nt, Artificial Sequence; identical to SEQ ID NO: 13911
  derived and/or modified sequence opt2 from major_capsid_protein__Norovirus__AHB62406

SEQ ID NO: 15434 - RNA, 1623 nt, Artificial Sequence
  derived and/or modified sequence opt2 from major_capsid_protein__Norovirus__AID51515
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccccggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcuccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15435 - RNA, 1623 nt, Artificial Sequence; identical to SEQ ID NO: 13903
  derived and/or modified sequence opt2 from major_capsid_protein__Norovirus__AID51517

SEQ ID NO: 15436 - RNA, 1623 nt, Artificial Sequence
  derived and/or modified sequence opt2 from major_capsid_protein__Norovirus__AID51519
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagucccgcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15437 - RNA, 1623 nt, Artificial Sequence
  derived and/or modified sequence opt2 from major_capsid_protein__Norovirus__AID51522
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15438 - RNA, 1623 nt, Artificial Sequence; identical to SEQ ID NO: 13909
  derived and/or modified sequence opt2 from major_capsid_protein__Norovirus__AID51531

SEQ ID NO: 15439 - RNA, 1623 nt, Artificial Sequence; identical to SEQ ID NO: 13855
  derived and/or modified sequence opt2 from major_capsid_protein__Norovirus__AID51534

SEQ ID NO: 15440 - RNA, 1623 nt, Artificial Sequence; identical to SEQ ID NO: 13855
  derived and/or modified sequence opt2 from major_capsid_protein__Norovirus__AIL49840

SEQ ID NO: 15441 - RNA, 1623 nt, Artificial Sequence
  derived and/or modified sequence opt2 from major_capsid_protein__Norovirus__AIL49843
augaagauggccuccuccgacgccaaccccuccgacggcuccgccgccaaccucguccccgaggucaacaacgaggucauggcccucgagcccuucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccucaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcuccgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15442 - RNA, 1623 nt, Artificial Sequence
  derived and/or modified sequence opt2 from major_capsid_protein__Norovirus__AIV99914
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcaccuacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacgcccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacucccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgucccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccagggcgccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 15443 - RNA, 1635 nt, Artificial Sequence
  derived and/or modified sequence opt2 from major_capsid_protein__Norovirus__AJP13619
auggccuccaaggacgccccccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcaacuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcggccgccucggcguccgccgcaucuga

SEQ ID NO: 15444 - RNA, 1632 nt, Artificial Sequence
  derived and/or modified sequence opt2 from major_capsid_protein__Norovirus__AJP13620
auggccuccaaggacgcccccaccaacauggacggcaccuccggcgccggccagcucguccccgaggccaacaccgccgagcccaucuccauggagcccgucgccggcgccgucaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcaucccccccggcuucgucgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcauccucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucaacaccggcgacgucaucaagcagaucaacgucaagcaggaguccgccuucgccccccaccucggcaccauccaggccgacggccucuccgacgucuccgucaacaccaacaugaucgccaagcucggcugggucucccccgucuccgacggccacaagcgcgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacaccuccggcaccggcccccagacccuccccaucaacggcgucuucgucuucgucuccugggucucccgcuucuaccagcucaagcccgucggcaccgccggccccgcccgccgccucggcauccgccgcuccuga

SEQ ID NO: 15445 - RNA, 1647 nt, Artificial Sequence
  derived and/or modified sequence opt2 from major_capsid_protein__Norovirus__AJP13621
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcaccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaagaucgacaccaccuccggccgcuucacccccaagcucggcucccucgagaucuccaccgaguccgacgacuucgaccagaacaagcccacccgcuucacccccgucggcaucggcgucgaccacgaggccgacuuccagcagugggcccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaucaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15446 - RNA, 1653 nt, Artificial Sequence
  derived and/or modified sequence opt2 from major_capsid_protein__Norovirus__AJP13622
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggcacccaggagcagggccacuacgccacccgcgcccacgaggcccacaucgacaccaccgaccccaaguacgcccccaagcucggcaccauccucaucaaguccgaguccaccgacuucaccaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuucggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 15447 - RNA, 1614 nt, Artificial Sequence
  derived and/or modified sequence opt2 from major_capsid_protein__Norovirus__AJP13623
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgacaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccgacuccgccaaguucacccccaagcucggcgccauccagaucggcaccugggaggaggacgacguccacaucaaccagcccaccaaguucacccccgucggccucuucgagcgcgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccagaagggcuga

SEQ ID NO: 15448 - RNA, 1623 nt, Artificial Sequence
  derived and/or modified sequence opt2 from major_capsid_protein__Norovirus__AJW67354
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccguccagggcauguucgucucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 15449 - RNA, 1644 nt, Artificial Sequence
  derived and/or modified sequence opt2 from major_capsid_protein__Norovirus__AJW67357
augaagauggccuccaacgacgccgcccccuccaacgacggcgccgccaaccucguccccgaggccaccaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccaucggcgccacccgcgcccacgagguccacaucgacaccaccaacccccgcuacacccccaagcucggcuccguccucauguacuccgaguccuccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucgucaccgucgccaacuccggcaacaaccccaucgucgucccccccaacggcuacuuccgcuucgaggccugggucaaccaguucuacacccucacccccaugggcaccggccagggccgccgccgcauccaguga

SEQ ID NO: 15450 - RNA, 1644 nt, Artificial Sequence
  derived and/or modified sequence opt2 from major_capsid_protein__Norovirus__AJW67359
augaagauggccuccaacgacgccgcccccuccaacgacggcgccgccaaccucguccccgaggccaccaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccaggccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccaucggcgccacccgcgcccacgaggcccacaucgacaccaccaacccccgcuacacccccaagcucggcuccguccucauguacuccgaguccuccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15451 - RNA, 1644 nt, Artificial Sequence
  derived and/or modified sequence opt2 from major_capsid_protein__Norovirus__AJW67362
augaagauggccuccaacgacgccgcccccuccaacgacggcgccgccaaccucguccccgaggccaccaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccaucggcgccacccgcgcccacgagguccacaucgacaccaccaacccccgcuacacccccaagcucggcuccguccucauguacuccgaguccaccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15452 - RNA, 1617 nt, Artificial Sequence; identical to SEQ ID NO: 15018
  derived and/or modified sequence opt2 from major_capsid_protein__Norovirus__AJW67368

SEQ ID NO: 15453 - RNA, 1617 nt, Artificial Sequence; identical to SEQ ID NO: 15018
  derived and/or modified sequence opt2 from major_capsid_protein__Norovirus__AJW67371

SEQ ID NO: 15454 - RNA, 1623 nt, Artificial Sequence
  derived and/or modified sequence opt2 from major_capsid_protein__Norovirus__AJW67374
auggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggccgcuucacccccaagaucggcaccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcaacuacccccucgucgucccccccaacggccacuuccgcuucgacuccugggucaaccaguucuacucccucgcccccaugggcaccggcaacggccgccgccgcguccaguga

SEQ ID NO: 15455 - RNA, 1635 nt, Artificial Sequence
  derived and/or modified sequence opt2 from major_capsid_protein__Norovirus__AJW67377
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgccggcuuccccgaccucggcuccugcgacuggcacaucgagauguccaagauccccaacuccuccaccgaguccaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccaacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucggcguccgccgcuga

SEQ ID NO: 15456 - RNA, 1617 nt, Artificial Sequence
  derived and/or modified sequence opt2 from major_capsid_protein__Norovirus__AJX18190
auggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccccccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccucgagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 15457 - RNA, 1617 nt, Artificial Sequence; identical to SEQ ID NO: 15018
  derived and/or modified sequence opt2 from major_capsid_protein__Norovirus__AJX18193

SEQ ID NO: 15458 - RNA, 1623 nt, Artificial Sequence; identical to SEQ ID NO: 14032
  derived and/or modified sequence opt2 from major_capsid_protein__Norovirus__AJZ77004

SEQ ID NO: 15459 - RNA, 1623 nt, Artificial Sequence; identical to SEQ ID NO: 13753
  derived and/or modified sequence opt2 from major_capsid_protein__Norovirus__AJZ77010

SEQ ID NO: 15460 - RNA, 1623 nt, Artificial Sequence
  derived and/or modified sequence opt2 from major_capsid_protein__Norovirus__AJZ77013
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15461 - RNA, 1623 nt, Artificial Sequence; identical to SEQ ID NO: 13763
  derived and/or modified sequence opt2 from major_capsid_protein__Norovirus__AJZ77015

SEQ ID NO: 15462 - RNA, 1623 nt, Artificial Sequence; identical to SEQ ID NO: 13761
  derived and/or modified sequence opt2 from major_capsid_protein__Norovirus__AJZ77019

SEQ ID NO: 15463 - RNA, 1623 nt, Artificial Sequence; identical to SEQ ID NO: 13855
  derived and/or modified sequence opt2 from major_capsid_protein__Norovirus__AJZ77022

SEQ ID NO: 15464 - RNA, 1623 nt, Artificial Sequence; identical to SEQ ID NO: 14127
  derived and/or modified sequence opt2 from major_capsid_protein__Norovirus__AJZ77027

SEQ ID NO: 15465 - RNA, 1623 nt, Artificial Sequence; identical to SEQ ID NO: 13909
  derived and/or modified sequence opt2 from major_capsid_protein__Norovirus__AJZ77030

SEQ ID NO: 15466 - RNA, 1623 nt, Artificial Sequence; identical to SEQ ID NO: 13252
  derived and/or modified sequence opt2 from major_capsid_protein__Norovirus__AJZ77033

SEQ ID NO: 15467 - RNA, 1623 nt, Artificial Sequence; identical to SEQ ID NO: 13252
  derived and/or modified sequence opt2 from major_capsid_protein__Norovirus__AJZ77036

SEQ ID NO: 15468 - RNA, 1623 nt, Artificial Sequence
  derived and/or modified sequence opt2 from major_capsid_protein__Norovirus__AKE31849
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccaggccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15469 - RNA, 1623 nt, Artificial Sequence
  derived and/or modified sequence opt2 from major_capsid_protein__Norovirus__AKE31852
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgucggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuuccaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcauccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15470 - RNA, 1623 nt, Artificial Sequence
  derived and/or modified sequence opt2 from major_capsid_protein__Norovirus__AKE31855
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgucguccaggucauccucgccggcaacgccuucaccgccggcaagaucaucuucgccgccgucccccccaacuuccccaccgagggccucucccccucccaggucaccauguucccccacaucaucgucgacgcccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccaccaagaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15471 - RNA, 1623 nt, Artificial Sequence
  derived and/or modified sequence opt2 from major_capsid_protein__Norovirus__AKE31858
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagacccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcgacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgaccgccuccucccccaggaguggguccaguacuucuaccaggagcccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15472 - RNA, 1623 nt, Artificial Sequence
  derived and/or modified sequence opt2 from major_capsid_protein__Norovirus__AKE31861
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgcccgccucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguuccacacccucgcccccaugggcaacggcaccggccgccgccgcgcccucuga

SEQ ID NO: 15473 - RNA, 1623 nt, Artificial Sequence
  derived and/or modified sequence opt2 from major_capsid_protein__Norovirus__AKE31864
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacauccgcaccuuccgcggcgacgucacccacauccccggcucccgcaacuacaccaugaacuccgccucccagaacuggaacuccuacgaccccaccgaggagauccccgccccccucggcacccccgacuucgucggcaagauccagggcguccucacccagaccacccgcgccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15474 - RNA, 1623 nt, Artificial Sequence
  derived and/or modified sequence opt2 from major_capsid_protein__Norovirus__AKE31867
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccgucuccaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcgccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15475 - RNA, 1623 nt, Artificial Sequence
  derived and/or modified sequence opt2 from major_capsid_protein__Norovirus__AKE31870
augaagauggccuccuccgacgccaaccccuccgacggcuccaccgccaaccucguccccgaggucaacaacgaggucauggcccucgagcccgucgucggcgccuccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucccccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacuaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagucccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15476 - RNA, 1623 nt, Artificial Sequence
  derived and/or modified sequence opt2 from major_capsid_protein__Norovirus__AKE31873
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggaugcuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15477 - RNA, 1623 nt, Artificial Sequence
  derived and/or modified sequence opt2 from major_capsid_protein__Norovirus__AKE31876
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgcccgcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccaacuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15478 - RNA, 1632 nt, Artificial Sequence
  derived and/or modified sequence opt2 from major_capsid_protein__Norovirus__AKF02368
augaagauggccuccaacgacgccgcccccuccaacgacggcgccgccggccucguccccgagaucaacaacgagaccauggcccucgagcccgucgccggcggcgccaucgccgccccccucaccggccagaccaacuucaucgaccccuggauccgcggcaacuacguccaggcccccaacggcgaguucaccgucuccccccgcaacucccccggcgagauccuccucaaccucgagcucggccccgagcucaaccccuuccucucccaccucucccgcauguacaacggcuacgccggcggcaucgacguccaggucaucauggccggcaacgccuucaccgccggcaagaucaucuucgccgccauccccccccacuuccccgucgagaaccucucccccccccagaucaccauguucccccacaucaucgucgacguccgcacccucgagcccaucaacauccccguccccgacguccgcaacaacuucuuccacuacaaccagaacaacgagucccgcaugcgccucgucgccaugcucuacaccccccuccgcuccaacggcuccgccgaggacgucuucaccgucuccugccgcguccucaccaagcccuccgccgacuucgaguucaacuaccucgucccccccaccgucgagucccgcaccaagcccuucaccauccccauccucaccaucggcgagaugaccaacucccgcuuccccguccccaucgacaugcuccacaccucccccaccgagaacaucgucguccagccccagaacggccgcugcaccaucgacggcgagcuccucggcaccacccagcucaucaccuccaacaucugcuccuuccgcggcuccaucuccggccacgagggcaacgacgaccagcaccucuggcacuucaacaucaccaaccccaacggcacccccuucgaccccaccgaggacguccccgccccccucggcacccccgacuuccgcggccagcucuacggcgucaucucccagcgcgaccgcgagggcacccccuccgagaacaaccagaaggccaaccgcucccacgagggcgucaucuccaccaucucccccaaguucguccccaagcucggcuccgucaugaucggcaccuggaccaccgacgacaucaagaaccagcccuccaaguucacccccaucggccucaacgacgacgacaacuucaagcagugggagcuccccaacuacuccggcgcccucacccucaacaugggccucgcccccuccgucuuccccaccuaccccggcgagcagguccucuucuuccgcuccuaccuccccaugaagggcggcuacggcucccccuucaucgacugccucgucccccaggagugggucgcccacuucuaccaggaguccgcccccgcccagaccgacgucgcccucauccgcuacgucaaccccgagaccggccgcguccucuucgaggccaagcuccaccgccagggcuucaucaccgucgccaaguccggcgacucccccaucaacguccccgccaacggcuacuuccgcuucgacuccugggucaaccaguucuacucccucgcccccaugggcaccggcaacggccgccgccgcauccaguga

SEQ ID NO: 15479 - RNA, 1644 nt, Artificial Sequence
  derived and/or modified sequence opt2 from major_capsid_protein__Norovirus__AKF42429
augaagauggccuccaacgacgccgcccccuccaacgacggcgccgccaaccucguccccgaggccaccaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccaucggcgccacccgcgcccacgagguccacaucgacaccaccaacccccgcuacacccccaagcucggcuccguccucauguacuccgaguccaccgacuucgacgacggccagcccacccgcuucacccccaucggcaugggcgccgacgacuggcaccagugggagcuccccgaguacuccggccaccucacccucuccaugucccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15480 - RNA, 1644 nt, Artificial Sequence
  derived and/or modified sequence opt2 from major_capsid_protein__Norovirus__AKF42434
augaagauggccuccaacgacgccgcccccuccaacgacggcgccgccaaccucguccccgaggccaccaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccaucggcgccacccgcgcccacgagguccacaucgacaccaccaacccccgcuacacccccaagcucggcuccguccucauguacuccgaguccuccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15481 - RNA, 1650 nt, Artificial Sequence
  derived and/or modified sequence opt2 from major_capsid_protein__Norovirus__AKF42437
augaagauggccuccaccgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucaagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcgucgucguccagccccagaacggccgcugcacccucgacggcacccuccagggcaccacccagcucguccccacccagaucugcgccuuccgcggcaagcucaucggccagaccucccgcucccccgacuccgacuccaccgacuccgccccccgccgccgcgaccacccccuccacguccagcucgagaaccucgacggcacccaguacgaccccaccgacgagguccccgccacccucggcgccgucgacuucaagggcaccaucuucggcgucgccucccagcgcgacaccuccggcucccaggucggcgccacccgcgcccacgagguccacaucaacaccaccgacccccgcuacacccccaagcucggcuccauccucauguacuccgagucccucgacuucgagaccggccagcccguccgcuucacccccaucggcaugggcgagaacgacuggcaccagugggagcuccccgacuacuccggccgccucacccucaacaugaaccucgcccccgccgucgcccccgccuuccccggcgagcgcauccucuucuuccgcuccaucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 15482 - RNA, 1623 nt, Artificial Sequence; identical to SEQ ID NO: 13702
  derived and/or modified sequence opt2 from major_capsid_protein__Norovirus__ALA27427

SEQ ID NO: 15483 - RNA, 1623 nt, Artificial Sequence
  derived and/or modified sequence opt2 from major_capsid_protein__Norovirus__ALD09618
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacgcccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15484 - RNA, 1623 nt, Artificial Sequence
  derived and/or modified sequence opt2 from major_capsid_protein__Norovirus__ALM96644
augaagauggccuccuccgacgccaaccccuccgacggcuccaccgccaaccucauccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacaucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15485 - RNA, 1623 nt, Artificial Sequence
  derived and/or modified sequence opt2 from major_capsid_protein__Norovirus__ALM96645
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcggcgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagguccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccguccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15486 - RNA, 1623 nt, Artificial Sequence
  derived and/or modified sequence opt2 from major_capsid_protein__Norovirus__ALM96646
augaagauggccuccaacgacgccaaccccuccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcaaguucaccgucucccccaagaacgcccccggcgagauccucugguccgccccccucggccccgaccucaaccccuaccucucccaccucgcccgcauguacaagggccacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15487 - RNA, 1623 nt, Artificial Sequence
  derived and/or modified sequence opt2 from major_capsid_protein__Norovirus__ALM96647
augaagauggccuccaacgacgccaaccccuccgacggcuccgccgccaaccucguccccaaggucaacaacgaggucauggcccucgagcccgucgucggcgccgccaucgccgcccccgucgccggccagcagaacgucaucgaccccuggauccgcaacaacuucguccaggcccccggcggcaaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15488 - RNA, 1623 nt, Artificial Sequence; identical to SEQ ID NO: 14230
  derived and/or modified sequence opt2 from major_capsid_protein__Norovirus__ALM98891

SEQ ID NO: 15489 - RNA, 1623 nt, Artificial Sequence; identical to SEQ ID NO: 14230
  derived and/or modified sequence opt2 from major_capsid_protein__Norovirus__ALM98892

SEQ ID NO: 15490 - RNA, 1623 nt, Artificial Sequence; identical to SEQ ID NO: 14230
  derived and/or modified sequence opt2 from major_capsid_protein__Norovirus__ALM98893

SEQ ID NO: 15491 - RNA, 1623 nt, Artificial Sequence; identical to SEQ ID NO: 14230
  derived and/or modified sequence opt2 from major_capsid_protein__Norovirus__ALM98894

SEQ ID NO: 15492 - RNA, 1623 nt, Artificial Sequence; identical to SEQ ID NO: 14230
  derived and/or modified sequence opt2 from major_capsid_protein__Norovirus__ALM98895

SEQ ID NO: 15493 - RNA, 1623 nt, Artificial Sequence; identical to SEQ ID NO: 13589
  derived and/or modified sequence opt2 from major_capsid_protein__Norovirus__ALM98896

SEQ ID NO: 15494 - RNA, 1623 nt, Artificial Sequence; identical to SEQ ID NO: 14230
  derived and/or modified sequence opt2 from major_capsid_protein__Norovirus__ALM98897

SEQ ID NO: 15495 - RNA, 1623 nt, Artificial Sequence; identical to SEQ ID NO: 14230
  derived and/or modified sequence opt2 from major_capsid_protein__Norovirus__ALM98899

SEQ ID NO: 15496 - RNA, 1623 nt, Artificial Sequence; identical to SEQ ID NO: 13907
  derived and/or modified sequence opt2 from major_capsid_protein__Norovirus__ALM98901

SEQ ID NO: 15497 - RNA, 1623 nt, Artificial Sequence
  derived and/or modified sequence opt2 from major_capsid_protein__Norovirus__ALM98907
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacauccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15498 - RNA, 1623 nt, Artificial Sequence
  derived and/or modified sequence opt2 from major_capsid_protein__Norovirus__ALM98910
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggacgccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15499 - RNA, 1623 nt, Artificial Sequence
  derived and/or modified sequence opt2 from major_capsid_protein__Norovirus__ALM98913
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcuccacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15500 - RNA, 1623 nt, Artificial Sequence; identical to SEQ ID NO: 14098
  derived and/or modified sequence opt2 from major_capsid_protein__Norovirus__ALM98916

SEQ ID NO: 15501 - RNA, 1623 nt, Artificial Sequence
  derived and/or modified sequence opt2 from major_capsid_protein__Norovirus__ALT54478
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15502 - RNA, 1617 nt, Artificial Sequence
  derived and/or modified sequence opt2 from major_capsid_protein__Norovirus__ALT54488
augaugauggccuccaaggacgcccccuccaacauggacggcaccuccggcgccggccagcucguccccgaggucaacgccgccgagccccucccccucgagcccgucgucggcgccgccaccgccgccgccaccgccggccaggucaacaugaucgaccccuggaucaugaacaacuucguccaggcccccgagggcgaguucaccaucucccccaacaacacccccggcgacauccucuucgaccuccgccucggcccccaccucaaccccuuccuccuccaccucucccagauguacaacggcugggucggcaacaugcgcguccgcgucaugcucgccggcaacgccuucuccgccggcaagaucaucaucugcugcgucccccccggcuucgagucccagaacaucuccaucggccaggccaccauguucccccacgucaucgccgacguccgcguccucgagcccaucgaggucccccucgacgacguccgcaacguccucuuccacaccaacgagaaccgccccaccaugcgccuccucugcaugcucuacaccccccuccgcgccggcggcgccuccuccggcaccgaccccuucgucaucgccggccgcguccucaccugccccgcccccgacuucaacuuccucuuccucgucccccccuccgucgagcagaagacccgccagcucaccauccccaacaucccccucaacaaccucgccaacucccgcguccccgccaugaucaacaagaugaccgucuccgccgaccagaaccaggucguccaguuccagaacggccgcugcacccucgagggccagcuccucggcaccacccccgucuccgccaaccaggucgcccgcauccgcggcaaggucuucuccaccaacuccggcaccggccucaaccucaccgaggucgacggcacccccuaccacgccuucgagucccccgccccccucggcuuccccgacaucggcaacugcgacuggcacgucuacgccuucaaggucaaccagaacaccggcgaccccauguaccgccucgacaucacccagggcaacuccuucgccccccaccucggcuccaucgaguucuccuccgagaaccaccccuccggcgaccagcucggcacccucaccuggaucuccccccucaacaacgccucccgcgucgaccccuggaagauccccaccuacggcuccacccucaccgaguccaccaaccucgccccccccaucuucccccccggcuucggcgaguccaucgucuacuucauguccgacuuccccaucgucuccggcaacaccgcccagauccccugcacccucccccaggaguucgucuccuccuucgucgagcagcaggcccccauccgcggcgaggccgcccuccuccacuacgucgaccccgacacccaccgcaaccucggcgaguucaagcucuaccccgacggcuucaucaccugcguccccaacaccggcggcggcccccagaaccuccccuccaacggcgucuucgucuucuccuccugggucucccgcuacuaccagcucaagcccgucggcaccaccggccccguccgccgccucggcguccgccgcgucuga

SEQ ID NO: 15503 - RNA, 1620 nt, Artificial Sequence
  derived and/or modified sequence opt2 from major_capsid_protein__Norovirus__ALT54491
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccagaucgccuccacccagaccuacaccaugaaccucgccucccucaacuggaacaacuacgaccccaccgaggagauccccgccccccucggcgcccccgacuucaugggcaagauccagggcguccucacccagaccacccgccagggcggcuccacccgcggccacaaggccaccgucuccaccggcuccguccacuucacccccaagcucggcuccguccgcuucgacaccgacaccaacaacgaccuccagccccaccaguccacccgcuucacccccgucggcgucauccaggacggcgacacccaccagaacgagccccagcagugggcccuccccugcuacuccggccgcgacgucaacaacguccaccucgcccccgccgucgcccccuccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacaaccucgucaucccccccaacggcuacuuccgcuucgacuccugggucaaccaguucuacacccucgcccccaugggcaacggcaccggccgccgccgcguccucuga

SEQ ID NO: 15504 - RNA, 1620 nt, Artificial Sequence
  derived and/or modified sequence opt2 from major_capsid_protein__Norovirus__ALT54494
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccagaucgccuccacccagaccuacaccaugaaccucgccucccucaacuggaacaacuacgaccccaccgaggagauccccgccccccucggcgcccccgacuucaugggcaagauccagggcguccucacccagaccacccgccaggacggcuccacccgcggccacaaggccaccgucuccaccggcuccguccacuucacccccaagcucggcuccguccgcuucgacaccgacaccaacaacaaccuccagccccaccaguccacccgcuucacccccgucggcgucauccaggacggcgacacccaccagaacgagccccagcaguggguccuccccugcuacuccggccgcgacgucaacaacguccaccucgcccccgccgucgcccccuccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacaaccucgucaucccccccaacggcuacuuccgcuucgacuccugggucaaccaguucuacacccucgcccccaugggcaacggcaccggccgccgccgcguccucuga

SEQ ID NO: 15505 - RNA, 1620 nt, Artificial Sequence
  derived and/or modified sequence opt2 from major_capsid_protein__Norovirus__BAM65003
augaugauggccuccaaggacgcccccuccaacauggacggcaccuccggcgccggccagcucguccccgaggucaacgccgccgagccccucccccucgagcccgucgucggcgccgccaccgccgccgccaccgccggccaggucaaccucaucgaccccuggaucaugaacaacuucguccaggcccccgagggcgaguucaccaucucccccaacaacacccccggcgacauccucuucgaccuccagcucggcccccaccucaaccccuuccuccagcaccucucccagauguacaacggcugggucggcaacaugcgcguccgcgucaugcucgccggcaacgccuucaccgccggcaagaucaucaucugcugcgucccccccggcuucgccucccagaacaucuccaucggccaggccaccauguucccccacgucaucgccgacguccgcguccucgagcccaucgagaucccccucgacgacguccgcaacguccucuuccacaccaacgagaaccgccccaccaugcgccuccucugcaugcucuacaccccccuccgcgccggcggcgccuccuccggcaccgaccccuucgucaucgccggccgcguccucaccugccccucccccgacuucaacuuccucuuccucgucccccccuccgucgagcagaagacccgccagcucaccguccccaacaucccccucaacaaccucgccaacucccgcguccccgccaugaucaacaagaugaccgucuccaccgaccagaaccaggucguccaguuccagaacggccgcugcacccucgagggccagcuccucggcaccacccccgucuccgccucccaggucgcccgcauccgcggcaaggucuucuccaccgccuccggcaagggccucaaccucaccgagcucgacggcacccccuaccacgccuucgagucccccgccccccucggcuuccccgacaucggcgccugcgacuggcacgucuccaccuucaaggucgaccagaaccucuccggcgaccccaugucccgccucgacaucaagcagaacgcccccuucgccccccaccucggcuccaucgaguucaccuccgaccaggagcccaccggcgaccagcucggcacccucgccugggucucccccuccaccuccggcgcccgcgucgaccccuggaagauccccuccuacggcuccaccgucaccgaguccacccaccucgccccccccaucuucccccccggcuucggcgaggccaucgucuacuucauguccgacuuccccaucgucuccggcaacaccgcccagguccccugcacccucccccaggaguucgucucccacuucgucgagcagcaggcccccauccgcggcgaggccgcccuccuccacuacgucgaccccgacacccaccgcaaccucggcgaguucaagcucuaccccgacggcuucaucaccugcguccccaacaccggcggcggcccccagaaccuccccaucaacggcgucuucgucuucuccuccugggucucccgcuacuaccagcucaagcccgucggcaccgccggccccgcccgccgccucggcguccgccgcgucuga

SEQ ID NO: 15506 - RNA, 1647 nt, Artificial Sequence
  derived and/or modified sequence opt2 from major_capsid_protein__Norovirus__BAM65005
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccggcgacuucgaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 15507 - RNA, 1644 nt, Artificial Sequence
  derived and/or modified sequence opt2 from major_capsid_protein__Norovirus__BAM65007
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 15508 - RNA, 1623 nt, Artificial Sequence; identical to SEQ ID NO: 13252
  derived and/or modified sequence opt2 from major_capsid_protein__Norovirus__CCX28604

SEQ ID NO: 15509 - RNA, 1623 nt, Artificial Sequence
  derived and/or modified sequence opt2 from major_capsid_protein__Norovirus__CCX28607
augaagauggccuccuccgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucgucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgaggccaaccagaacaccaaguucacccccgucggcgucauccaggacggcuccaccgcccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15510 - RNA, 1623 nt, Artificial Sequence
  derived and/or modified sequence opt2 from major_capsid_protein__Norovirus__CCX28619
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15511 - RNA, 1623 nt, Artificial Sequence
  derived and/or modified sequence opt2 from major_capsid_protein__Norovirus__CCX28622
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccgcccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15512 - RNA, 1623 nt, Artificial Sequence; identical to SEQ ID NO: 15510
  derived and/or modified sequence opt2 from major_capsid_protein__Norovirus__CCX28625

SEQ ID NO: 15513 - RNA, 1623 nt, Artificial Sequence; identical to SEQ ID NO: 15511
  derived and/or modified sequence opt2 from major_capsid_protein__Norovirus__CCX28628

SEQ ID NO: 15514 - RNA, 1623 nt, Artificial Sequence; identical to SEQ ID NO: 13252
  derived and/or modified sequence opt2 from major_capsid_protein__Norovirus__CCX28631

SEQ ID NO: 15515 - RNA, 1623 nt, Artificial Sequence; identical to SEQ ID NO: 15510
  derived and/or modified sequence opt2 from major_capsid_protein__Norovirus__CCX28634

SEQ ID NO: 15516 - RNA, 1623 nt, Artificial Sequence
  derived and/or modified sequence opt2 from major_capsid_protein__Norovirus__CCX28637
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15517 - RNA, 1623 nt, Artificial Sequence; identical to SEQ ID NO: 13252
  derived and/or modified sequence opt2 from major_capsid_protein__Norovirus__CCX28640

SEQ ID NO: 15518 - RNA, 1623 nt, Artificial Sequence; identical to SEQ ID NO: 15510
  derived and/or modified sequence opt2 from major_capsid_protein__Norovirus__CCX28643

SEQ ID NO: 15519 - RNA, 1623 nt, Artificial Sequence; identical to SEQ ID NO: 13252
  derived and/or modified sequence opt2 from major_capsid_protein__Norovirus__CCX28646

SEQ ID NO: 15520 - RNA, 1623 nt, Artificial Sequence; identical to SEQ ID NO: 13444
  derived and/or modified sequence opt2 from major_capsid_protein__Norovirus__CCX28649

SEQ ID NO: 15521 - RNA, 1623 nt, Artificial Sequence; identical to SEQ ID NO: 15511
  derived and/or modified sequence opt2 from major_capsid_protein__Norovirus__CCX28652

SEQ ID NO: 15522 - RNA, 1626 nt, Artificial Sequence; identical to SEQ ID NO: 13607
  derived and/or modified sequence opt2 from major_capsid_protein_VP1__Norovirus__AEE10000

SEQ ID NO: 15523 - RNA, 1626 nt, Artificial Sequence; identical to SEQ ID NO: 13610
  derived and/or modified sequence opt2 from major_capsid_protein_VP1__Norovirus__AEE10012

SEQ ID NO: 15524 - RNA, 1623 nt, Artificial Sequence; identical to SEQ ID NO: 14177
  derived and/or modified sequence opt2 from major_capsid_protein_VP1__Norovirus__AGJ52172

SEQ ID NO: 15525 - RNA, 1623 nt, Artificial Sequence; identical to SEQ ID NO: 14101
  derived and/or modified sequence opt2 from major_capsid_protein_VP1__Norovirus__AGJ52173

SEQ ID NO: 15526 - RNA, 1623 nt, Artificial Sequence; identical to SEQ ID NO: 13911
  derived and/or modified sequence opt2 from major_capsid_protein_VP1__Norovirus__AGJ52174

SEQ ID NO: 15527 - RNA, 1632 nt, Artificial Sequence; identical to SEQ ID NO: 14231
  derived and/or modified sequence opt2 from major_capsid_protein_VP1__Norovirus__AGJ52176

SEQ ID NO: 15528 - RNA, 1608 nt, Artificial Sequence
  derived and/or modified sequence opt2 from major_capsid_region__Norovirus__ADO85555
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagcccuggaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggagaacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcaucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 15529 - RNA, 1626 nt, Artificial Sequence
  derived and/or modified sequence opt2 from majore_capsid_protein__Norovirus__AFO84035
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcgcccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguaccaguccgaggucggcgaggucgccaccuucacccucaucgagcaggacggcuccgccuacguccccggcgaccgcgccgccccccucggcuaccccgacuacuccggccagcucgagaucgagguccagaccgagaccaccaagaccggcgacaagcucaaggucaccaccuucgacaugauccucggccccaccaccaacgucgaccagguccccuaccagggcaaggucuacgccucccucaccaccgccuccucccucgaccucgucgacggccgcgcccgcgccgucccccgcuccgucuacuccuuccaggacguccuccccgaguacaacgacggccuccucgucccccucgcccccccccucggccccuaccuccccggcgagguccuccuccgcuuccgcaccuacaugcgccagcucgacaccgccgacgccgccgcccagcccaucgacugcgcccucccccaggaguucaucuccugguucgccuccaacaacuucaccguccaguccgacgcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgucaccggccgcacccucaagcaguga

SEQ ID NO: 15530 - RNA, 1623 nt, Artificial Sequence
  derived and/or modified sequence opt2 from major_viral_capsid_protein__Norovirus__AFN09918
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccaccucccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 15531 - RNA, 1623 nt, Artificial Sequence; identical to SEQ ID NO: 13702
  derived and/or modified sequence opt2 from major_viral_capsid_protein__Norovirus__AFN09921

SEQ ID NO: 15532 - RNA, 1623 nt, Artificial Sequence
  derived and/or modified sequence opt2 from major_viral_capsid_protein__Norovirus__AFN09924
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcaacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15533 - RNA, 1623 nt, Artificial Sequence; identical to SEQ ID NO: 13702
  derived and/or modified sequence opt2 from major_viral_capsid_protein__Norovirus__AFN09927

SEQ ID NO: 15534 - RNA, 1623 nt, Artificial Sequence
  derived and/or modified sequence opt2 from major_viral_capsid_protein__Norovirus__AFN09930
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaucaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15535 - RNA, 1623 nt, Artificial Sequence; identical to SEQ ID NO: 13702
  derived and/or modified sequence opt2 from major_viral_capsid_protein__Norovirus__AFN09933

SEQ ID NO: 15536 - RNA, 1623 nt, Artificial Sequence; identical to SEQ ID NO: 13702
  derived and/or modified sequence opt2 from major_viral_capsid_protein__Norovirus__AFN09936

SEQ ID NO: 15537 - RNA, 1623 nt, Artificial Sequence
  derived and/or modified sequence opt2 from major_viral_capsid_protein__Norovirus__AFN09939
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15538 - RNA, 1623 nt, Artificial Sequence; identical to SEQ ID NO: 13702
  derived and/or modified sequence opt2 from major_viral_capsid_protein__Norovirus__AFN09942

SEQ ID NO: 15539 - RNA, 1623 nt, Artificial Sequence
  derived and/or modified sequence opt2 from major_viral_capsid_protein__Norovirus__AFN09945
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15540 - RNA, 1623 nt, Artificial Sequence
  derived and/or modified sequence opt2 from major_viral_capsid_protein__Norovirus__AFN09948
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucggccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15541 - RNA, 1623 nt, Artificial Sequence; identical to SEQ ID NO: 13702
  derived and/or modified sequence opt2 from major_viral_capsid_protein__Norovirus__AFN09951

SEQ ID NO: 15542 - RNA, 1623 nt, Artificial Sequence
  derived and/or modified sequence opt2 from major_viral_capsid_protein__Norovirus__AFN09954
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgaccucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15543 - RNA, 1623 nt, Artificial Sequence
  derived and/or modified sequence opt2 from major_viral_capsid_protein__Norovirus__AFN09957
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15544 - RNA, 1623 nt, Artificial Sequence
  derived and/or modified sequence opt2 from major_viral_capsid_protein__Norovirus__AFN09960
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuuccgcggccgcuccuccgcccucgucguccacccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgaguacaagcuccacaaguccgacuacgucaccgucgcccacaccggccagcacgaccucgucaucccccccaacggcuacuuccgcuucgacuccugggucaaccaguucuacacccucgccgccaugggcaacggcaccggccgccgccgcgcccucuga

SEQ ID NO: 15545 - RNA, 1623 nt, Artificial Sequence
  derived and/or modified sequence opt2 from major_viral_capsid_protein__Norovirus__AFN09963
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccuccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15546 - RNA, 1623 nt, Artificial Sequence; identical to SEQ ID NO: 13702
  derived and/or modified sequence opt2 from major_viral_capsid_protein__Norovirus__AFN09966

SEQ ID NO: 15547 - RNA, 1623 nt, Artificial Sequence; identical to SEQ ID NO: 14516
  derived and/or modified sequence opt2 from major_viral_capsid_protein__Norovirus__AFN09969

SEQ ID NO: 15548 - RNA, 1623 nt, Artificial Sequence
  derived and/or modified sequence opt2 from major_viral_capsid_protein__Norovirus__AFN09972
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15549 - RNA, 1593 nt, Artificial Sequence
  derived and/or modified sequence opt2 from major_viral_capsid_protein__Norovirus__AFN09975
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccuccccccgcuucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacggccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15550 - RNA, 1623 nt, Artificial Sequence
  derived and/or modified sequence opt2 from major_viral_capsid_protein__Norovirus__AFN09978
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccugcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15551 - RNA, 1623 nt, Artificial Sequence
  derived and/or modified sequence opt2 from major_viral_capsid_protein__Norovirus__AFN09981
augaagauggccuccaacgacgucaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15552 - RNA, 1623 nt, Artificial Sequence
  derived and/or modified sequence opt2 from major_viral_capsid_protein__Norovirus__AFN09984
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcgucauguucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15553 - RNA, 1623 nt, Artificial Sequence; identical to SEQ ID NO: 13292
  derived and/or modified sequence opt2 from major_viral_capsid_protein__Norovirus__AFN09987

SEQ ID NO: 15554 - RNA, 1623 nt, Artificial Sequence; identical to SEQ ID NO: 13292
  derived and/or modified sequence opt2 from major_viral_capsid_protein__Norovirus__AFN09990

SEQ ID NO: 15555 - RNA, 1623 nt, Artificial Sequence
  derived and/or modified sequence opt2 from major_viral_capsid_protein__Norovirus__AFN09993
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacgaccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacuccguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15556 - RNA, 1623 nt, Artificial Sequence; identical to SEQ ID NO: 13292
  derived and/or modified sequence opt2 from major_viral_capsid_protein__Norovirus__AFN09996

SEQ ID NO: 15557 - RNA, 1623 nt, Artificial Sequence; identical to SEQ ID NO: 14516
  derived and/or modified sequence opt2 from major_viral_capsid_protein__Norovirus__AFN09999

SEQ ID NO: 15558 - RNA, 1623 nt, Artificial Sequence
  derived and/or modified sequence opt2 from major_viral_capsid_protein__Norovirus__AGC96529
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacauccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15559 - RNA, 1623 nt, Artificial Sequence
  derived and/or modified sequence opt2 from major_viral_capsid_protein__Norovirus__AGC96532
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagacccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15560 - RNA, 1644 nt, Artificial Sequence
  derived and/or modified sequence opt2 from major_viral_capsid_protein__Norovirus__AGC96535
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcuccuccgucggcgccacccgcgcccacgagguccacaucgacaccaccaacccccgcuacacccccaagcucggcuccguccucaugcacuccgaguccuccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15561 - RNA, 1623 nt, Artificial Sequence
  derived and/or modified sequence opt2 from major_viral_capsid_protein__Norovirus__AGS16690
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccaacuacuccggcuccgacguccccaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15562 - RNA, 1623 nt, Artificial Sequence; identical to SEQ ID NO: 15561
  derived and/or modified sequence opt2 from major_viral_capsid_protein__Norovirus__AGS16693

SEQ ID NO: 15563 - RNA, 1623 nt, Artificial Sequence; identical to SEQ ID NO: 14230
  derived and/or modified sequence opt2 from major_viral_capsid_protein__Norovirus__ALM98919

SEQ ID NO: 15564 - RNA, 1623 nt, Artificial Sequence; identical to SEQ ID NO: 14230
  derived and/or modified sequence opt2 from major_viral_capsid_protein__Norovirus__ALM98922

SEQ ID NO: 15565 - RNA, 1623 nt, Artificial Sequence; identical to SEQ ID NO: 14230
  derived and/or modified sequence opt2 from major_viral_capsid_protein__Norovirus__ALM98928

SEQ ID NO: 15566 - RNA, 1623 nt, Artificial Sequence; identical to SEQ ID NO: 14230
  derived and/or modified sequence opt2 from major_viral_capsid_protein__Norovirus__ALM98931

SEQ ID NO: 15567 - RNA, 1623 nt, Artificial Sequence; identical to SEQ ID NO: 13589
  derived and/or modified sequence opt2 from major_viral_capsid_protein__Norovirus__ALM98934

SEQ ID NO: 15568 - RNA, 1623 nt, Artificial Sequence
  derived and/or modified sequence opt2 from major_viral_capsid_protein__Norovirus__ALM98940
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15569 - RNA, 1623 nt, Artificial Sequence; identical to SEQ ID NO: 14230
  derived and/or modified sequence opt2 from major_viral_capsid_protein__Norovirus__ALM98943

SEQ ID NO: 15570 - RNA, 1623 nt, Artificial Sequence
  derived and/or modified sequence opt2 from putative_capsid_protein__Norovirus__ABD73936
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacgucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 15571 - RNA, 1560 nt, Artificial Sequence
  derived and/or modified sequence opt2 from structural_capsid_protein__Norovirus__ABY67257
augaagaugaccgacaaggacacccaggaggccgcccccgcccucggccagguccucccccccgaggucgaggucgccauccccgucgagcccaccgccggcgcccagaucgccgcccccaccgccggccaggucaaccccaucgaccccuggaucuucgccaacuucguccaggccccccagggcgaguucaccaucucccccaacaacaaccccggcgagguccucuucgagcucgagcucggccccgagcucaaccccuaccucgcccaccuccgccagauguacaacggcuggaccggcuccauccgcgucaaggucauccucgccggcaacgccuucuccgccggcaagaucaucgucuucugcaucccccccggcuucgacgccuccuaccucacccccuuccaggccacccaguucccccacgucaucauggacguccgcgccgccgagcccaucgagaucccccucgccgacguccgcaacguccucuuccaccagggccccgacucccgcaugcgccucaugggcaugcucuacaccccccuccgcgccaacuccggcgccgaccccuucgucgucaccggccgcguccucaccugccccucccccgacuucuccuucuucuuccucgucccccccaccgucgaggagcgcuccacccccuucuccguccccaacguccccgucuacucccucaccaacucccgcgcccccguccccaucuacgagcuccgcuccucccgcucccucccccucaccguccaguuccagaacggccgcugcaccgucgagggcgaccuccucggcaccacccccuucuccgccggcgaccucugcuccuucaugugcauccgcggcgacacccagcacaucgccgagcuccucgagcccgacgaguccgccuucgucgucggcgagcgccccgccacccucggcuuccccgacuucucccagugcguccuccaccuccuccucgccgacggcaccggcaucuggcaccagucccucgacgucaagaacccccagcacuucacccccgccaucggccaggucguccucuccggcgacgucccccucacccgcacccgcguccgccucgacuacguccucuccaccucccgcgacuccuucuggguccuccccgacuaccgcuccgacguccucggcuccgaguucgcccccgccgucuccgcccccggcgucggcgagacccuccucuucuucaugggccgcgcccccguccagggccccuccaacccccuccccugccuccucccccucgagugggucuuccacuucgccuccgagcgccccaccaagcaguccgacgucgcccuccucaacuacgucaaccccgacaccggccgcguccucuucgaggccaagcucuacuccuccggcuuccucaccgucaaccucggcaccgccaacgaggucguccuccccaccuccggcaucuucaaguucgccuccugggucucccucuacuaccagcuccgccccgucggcacccucuccgccggccgccgccucccccgcgucgacggcuacuga

SEQ ID NO: 15572 - RNA, 1653 nt, Artificial Sequence
  derived and/or modified sequence opt2 from viral_capsid_protein__Norovirus__AHA91656
augaugauggccuccaaggacgccaccuccaacauggacggcaccuccggcgccggccagcucguccccgagaacaacaacaccuccgagcccaucaacauggagcccgucgccggcgccgucaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucgcccaccucucccagauguacaacggcugggucggcaacaugaagguccgcgucguccucgccggcaacgccuucuccgccggcaagaucaucgucugcugcaucccccccggcuucuccgcccccaacaucuccaucgcccaggccaccauguucccccacgucaucgccgacguccgcguccucgagcccaucgacaucccccucgacgacguccgcaacguccucuuccacaacaacgacaacggcaaccagaccaugcgccuccucugcaugcucuacaccccccuccgcuccggcggcaccuccuccggcaccgaccccuucgucaucgccggccgcguccucaccugccccacccccgacuucaacuuccucuuccucgucccccccaccgucgagcagaagaccaagcaguucuccguccccaaccucccccucaacgucauguccaacucccgcguccccucccuccucaacgccauggucgucucccccgaccaggcccaggucguccaguuccagaacggccgcugcacccucgacggccagaugcucggcaccaccaccgucuccgccuccugcgucgcccgcuuccgcggcaagaccuuccaggcccccgacaaccgccucggcaucaaccucgccgagaucuccggcgagcccuaccacgccuucgagucccccgccccccucggcuuccccgacuucggcgacggcgacuggcacgucaccgccaccaaggucacccccucccagcucgaggccaacgaccccgucgucaugggcaacguccagcccuacaacccccaguucgccccccaccucggcacccucgucgucgagaaccccacccccgacaacgucaccaccggcaccgaccuccucuucaacaucaccuggcucuccaaccgcgccaacaaccgcuucaaccccugggucauccccaacuacggcuccacccucaccgaggccgcccagcucgcccccuccaucuucccccccggcuucggcgagaccaucgucuacuucaacuccaccuuccccgccgucggcgccaccacccacgccgccauccccugccuccucccccaggaguucgucgcccacuucgucaacgagcaggcccccauccgcggcgaggccgcccuccuccacuacaucgaccccgacacccaccgcaaccucggcgaguucaagaucuaccccgagggcuucgucaccugcguccccaacgucggcggcaccggcccccagucccuccccaccaacggcaucuucgucuucgucuccugggucucccgcuacuaccagcucaagcccgucggcaccgccggccaggcccgccgccucggcuuccgccgcgucuga

SEQ ID NO: 15573 - RNA, 1629 nt, Artificial Sequence; identical to SEQ ID NO: 13637
  derived and/or modified sequence opt2 from VP1_capsid_protein__Norovirus__BAL60747

SEQ ID NO: 15574 - RNA, 1629 nt, Artificial Sequence; identical to SEQ ID NO: 13638
  derived and/or modified sequence opt2 from VP1_capsid_protein__Norovirus__BAL60751

SEQ ID NO: 15575 - RNA, 1629 nt, Artificial Sequence; identical to SEQ ID NO: 13645
  derived and/or modified sequence opt2 from VP1_capsid_protein__Norovirus__BAL60763

SEQ ID NO: 15576 - RNA, 1629 nt, Artificial Sequence; identical to SEQ ID NO: 13648
  derived and/or modified sequence opt2 from VP1_capsid_protein__Norovirus__BAL60765

SEQ ID NO: 15577 - RNA, 1629 nt, Artificial Sequence; identical to SEQ ID NO: 13659
  derived and/or modified sequence opt2 from VP1_capsid_protein__Norovirus__BAL60787

SEQ ID NO: 15578 - RNA, 1629 nt, Artificial Sequence; identical to SEQ ID NO: 13660
  derived and/or modified sequence opt2 from VP1_capsid_protein__Norovirus__BAL60789

SEQ ID NO: 15579 - RNA, 1629 nt, Artificial Sequence; identical to SEQ ID NO: 13671
  derived and/or modified sequence opt2 from VP1_capsid_protein__Norovirus__BAL60807

SEQ ID NO: 15580 - RNA, 390 nt, Artificial Sequence
  derived and/or modified sequence opt2 from capsid__Norovirus__ACL14997
auggccuccaacgacgccgcccccuccaacgacggcgccgccggccucguccccgaguccaacaacgaggucauggcccucgagcccgucgccggcgccucccucgccgcccccgucaccggccagaccaacaucaucgaccccuggauccgcaugaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcauggagguccagaucaugcucgccggcaacgccuucaccgccggcaagcucaucuucgccgccgucccccccuacaaccgccgcugcuga

SEQ ID NO: 15581 - RNA, 561 nt, Artificial Sequence
  derived and/or modified sequence opt2 from truncated_capsid_protein__Norovirus__ACB56490
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacgucaugcagcucgagcccguccucaucccccuccccgacguccgcaacaacuucuaccacuacaaccaguccaacgacuccaccaucaaguucgacuccaacgccgucuacaccaccuga

SEQ ID NO: 15582 - RNA, 627 nt, Artificial Sequence
  derived and/or modified sequence opt2 from truncated_capsid_protein__Norovirus__ACF77106
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccaucuccuga

SEQ ID NO: 15583 - RNA, 627 nt, Artificial Sequence
  derived and/or modified sequence opt2 from truncated_capsid_protein__Norovirus__ACF77107
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccuga

SEQ ID NO: 15584 - RNA, 66 nt, Artificial Sequence
  derived and/or modified sequence opt2 from truncated_capsid_protein__Norovirus__ACU28807
augaagauggccuccaacgacgcccaccccuccgacggcuccgccgccaccuccucccagcgcuga

SEQ ID NO: 15585 - RNA, 312 nt, Artificial Sequence
  derived and/or modified sequence opt2 from truncated_capsid_protein__Norovirus__ACU28808
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggccucuga

SEQ ID NO: 15586 - RNA, 123 nt, Artificial Sequence
  derived and/or modified sequence opt2 from truncated_capsid_protein__Norovirus__ACV03476
augaagauggccuccaugacccccacccaccucaugggcccccagcccaccuccucccagcgcuccaccaugcgccucuggcucugguccccccucuccgucccccuccuccgccgccucuga

SEQ ID NO: 15587 - RNA, 87 nt, Artificial Sequence
  derived and/or modified sequence opt2 from truncated_capsid_protein__Norovirus__ACV03479
augaagauggccuccaugaccccccuccaccucaugauggucccccccgccuccucccagcgcuccaccaugcgccaguggcgcuga

SEQ ID NO: 15588 - RNA, 1623 nt, Artificial Sequence
  derived and/or modified sequence opt2 from capsid_protein__Norovirus__AFN70960.1
augaagauggccuccaaggacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgccccccucggcaacggcaccggccgccgccgcgcccucuga

SEQ ID NO: 15589 - RNA, 1629 nt, Artificial Sequence
  derived and/or modified sequence opt2 from VP1__Norovirus_and/or_Norovirus-like__X81879
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagaagaucaccauguucccccacgucaucaucgacguccgcacccucgagcccguccuccucccccuccccgacguccgcaacuccuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccguccccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucaacaacgucaccaucaccaaccucaacggcucccccuucgaccccuccgaggacauccccgccccccucggcguccccgacuuccagggccgcgucuucggcgucaucucccagcgcgacaagcagaacgccgccggccacuccgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcucccaccucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15590 - RNA, 1728 nt, Artificial Sequence
  derived and/or modified sequence opt2 from VP1__Norovirus_and/or_Norovirus-like__FJ875027
augaagauggccuccaacgacgccgccccccccuccuccgacggcgccgccaaccucguccccgagaucaacaacgaggucauggcccucgagcccgucgccggcgcccagcucgccgcccccgucgccggccaguucaacgccaucgaccccuggauccgccagaacuucguccaggcccccgagggcgaguucaccgucuccccccgcaacgcccccggcgagauccuccucaaccucgagcucggcccccaccucaaccccuuccuccagcaccucgcccagauguacaacgccuacgccggcggcauggagguccaggucguccucgccggcaacgccuucaccgccggcaagaucaucuucgccgccauccccccccacuucccccccgagcgccucuccgccgcccaggccacccaguucccccacgucaucgucgacguccgccagcucgagcccaucguccucccccuccccgacguccgccacaaccucuuccacuucaaccagcagaacgacgagcgcaugcaccucgucgccuuccucuacaccccccuccgcgccaacuccggcaacggcgacgacgucuucaccgucuccugccgcguccucacccgccccucccaggacuucgaguucauguuccucgucccccccaccgucgagaagaagaccgucgccuucucccucccccagcucgccgucggcgagauguccaacucccgcuggcccgcccgcaucaccggcauggucgucgacccccgccucccccagguccuccacauccagaacggccgcugcacccucgacggcacccucaugggcaccacccagcucaaccccaacgacaucugccgcauccgcggcuacuucuccuccucccgccccgagcuccucugcgagggcgaggaguccgaggucaacaccacccccaccgacuccggcgccaccggcgaccagacccccgagguccgcaccggcacccgcgccacccagcgcugguucgccgucaccgagcucaacggccaggucuacgaccccuucggcgaccagcccgccccccucggcguccccgacuucaaggcccgcauccucggcgcccucaugcgccuccccggcaccaaccccaccuccaacucccgcuucgaggacgccugggucgagaccaacaaccagaccaccuacgcccccgccaccggcgucgucgccaucaccaccaacgacaacuccuccggcaacuacgccaacgaccagaccugcgaguucgucccccucggcaucgagaucaccgacuccgcccccuacaacgaguucgaccuccccuccuacggcggcgccgccuccuccggcaaccgcaaccucgcccccaccgucgcccccaccuuccccggcgaggccauccuccucuucggcuccaacaugcccgucuacaaccgcuccuccggcaccgacaacaaggacauccgcugccuccuccccaacgaguacguccagcaccucuacgacacccaggcccccucccucuccgacgucgcccucguccgcuacgucaaccgcgacaccggccgcguccucuucgaggccaagcuccaccgcgacggcuucaugaccgucaacgccuccuccaccaccguccuccccgucgacggcuacuuccgcuucgacuccugggucaaccaguucuacgcccucucccccgucggcaacgccuccggccgccgcuga

SEQ ID NO: 15591 - RNA, 1725 nt, Artificial Sequence
  derived and/or modified sequence opt2 from VP1__Norovirus_and/or_Norovirus-like__JF939046
augaagauggccuccaacgacgccgccucccccuccuccgacggcgccgccaaccucguccccgagaucaacaacgaggucauggcccucgagcccgucgccggcgcccagcucgccgcccccgucgccggccaguucaacgccaucgaccccuggauccgccagaacuucguccaggcccccgagggcgaguucaccgucuccccccgcaacgcccccggcgagauccuccucaaccucgagcucggcccccaccucaaccccuuccuccagcaccucgcccagauguacaacgccuacgccggcggcauggagguccaggucguccucgccggcaacgccuucaccgccggcaagaucaucuucgccgccguccccccccacuucccccccgagcgccucuccgccgcccaggccacccaguucccccacgucaucgucgacguccgccagcucgagcccaucauccucccccuccccgacguccgccacaaccucuuccacuucaaccagcagaacgacgagcgcaugcaccucgucgccuuccucuacaccccccuccgcgccaacuccggcuccggcgacgacgucuucaccgucuccugccgcguccucacccgccccucccaggacuucgaguucauguuccucgucccccccaccgucgagaagaagaccgucgccuucucccucccccagcucgccaucggcgagauguccaacucccgcuggcccgcccgcaucaccggccucgucgucgacccccgccucccccagguccuccacauccagaacggccgcugcacccucgacggcacccucaugggcaccacccagcucaaccccaacgacaucugccgcauccgcggcuacuucuccuccucccgccccgagcuccucugcgagaacgaggaguccgccaccgaccccaugcccaccgagaccgacaccgacaaccagccccccgagguccgcgcccaggcccgcgccacccagcgcugguucgccgucaccgagcucaacggccaggucuacgaccccuucggcgaccagcccgccccccucggcguccccgacuucaaggcccgcauccucggcgcccucaugcgccuccccggcaccaaccccaccuccaacucccgcuucgaggacgccugggucgagaccaacaaccagaccaccuacgcccccgccgccggcgucgucgccaucaccaccaacgacaacuccuccuccaacuacgccaacgaccagaccugcgaguucgucccccucggcaucgagaucaccgacuccgcccccuaccacgaguucgaccuccccuccuacggcggcgccgccuccuccggcaaccgcaaccucgcccccaccgucgcccccaccuuccccggcgaggccauccuccucuucggcuccaacaugcccgucuacaaccgcaacaccggcaccuccaacaaggacauccgcugccuccuccccaacgaguacguccagcaccucuacgacacccaggcccccucccucuccgacgucgcccucguccgcuacgucaaccgcgacaccggccgcguccucuucgaggccaagcuccaccgcgacggcuucaugaccgucaacgccuccuccaccaccguccuccccgucgacggcuacuuccgcuucgacuccugggucaaccaguucuacgcccucucccccgucggcaacgccuccggccgccgcuga

SEQ ID NO: 15592 - RNA, 1722 nt, Artificial Sequence
  derived and/or modified sequence opt2 from VP1__Norovirus_and/or_Norovirus-like__JF930689
augaagauggccuccaacgacgccaccgcccccucccaggacggcgccgccaaccucguccccgagucccagcacgagguccucgcccucgagcccgucgccggcgccgcccucgccgcccccgucgccggccaguucaacgccaucgaccccuggaucaagcagaacuucguccaggcccccgccggcgaguucaccgucuccccccgcaacgcccccggcgagauccucauggaccucgagcucggccccgagcucaaccccuuccucgcccaccucgcccagauguacaacgccuacgccggcggcauggagguccagaucauccucgccggcaacgccuucaccgccggcaagaucaucgucugcgccgucccccccaacuucccccccgaccgccucuccgccucccaggccaccaacuucccccacgucaucauggacguccgcacccucgagcccgucauccucccccuccccgacguccgcgccggcuucuuccacuacaaccagcuccgcgagccccgcaugcgccucauggcccuccucuacaccccccuccgcgccaacggcaccggcgacgacgccuucaccgucuccugccgcguccucacccgccccaugcaggacuucgaguucauguuccucgucccccccaccgucgagucccgcgucacccccuucuccguccccaccuaccccgucgucgagaugaccaacucccgcuggcccgcccgcaucuccggcaugcacgucaacgccaaccagacccucgccguccaguuccagaacggccgcugcacccucgacggccagcucaugggcaccacccagcucugcgccgccgacgucugccgcaugcgcggccgcuacaccuccacccgcgccgaccucgccggcgucgaccacaccgaccagggccccucccucggcaccggccccuccgacgacuccgucuccguccccgaggcccgcgcccagacccgcaccggcgucuccgcccaccuccagcucgaggagcucaacggccagcccuacgaggucuacggcgagcagcccgccccccucggcacccccgacuuccgcugccgccucaugggcgagcucguccgccuccccuccaccucccccgccgcccagucccgcuuccgcgacgccuucuucgacaccuacggcgcccucuucgcccccgccgucggcuccaccaccuucaccgucaacaacuccuccaccuccgacuucgccaacggccagcccuucgaguuccuccccaucggcgucgagaucggcaacuccgcccaguacgacgaguucgcccuccccuccuacaacggcgccaucggcgagaaccgccaccucgcccccgucgccgcccccggcuuccccggcgagaacaucgucuucuucuccuccaaccuccccgucugggacuccaccuccgcccagaacaaccgccgcaucuccugccuccuccccaacgaguucguccagcacuucuacgaccuccaggcccccucccaguccgacgucgcccuccuccgcuacguccaccccgaguccggccgcguccucuucgagugcaagcucuaccgcgacggcuuccucaccgucaacggcgccucccucgccgaguuccccgucaacggcuacuuccgcuucgacuccugggucaaccaguucuucacccucucccccgucggcaccggcuccggccgccgcuga

SEQ ID NO: 15593 - RNA, 1719 nt, Artificial Sequence
  derived and/or modified sequence opt2 from VP1__Norovirus_and/or_Norovirus-like__GQ443611
augaagauggccuccaacgacgccaccgcccccucccaggacggcgccgccaaccucguccccgagucccagcacgagguccucgcccucgagcccgucgccggcgccgcccucgccgcccccgucgccggccaguucaacgccaucgaccccuggaucaagcagaacuucguccaggcccccgccggcgaguucaccgucuccccccgcaacgcccccggcgagauccucauggaccucgagcucggccccgagcucucccccuuccucgcccaccucgcccagauguacaacgccuacgccggcggcauggagguccagaucauccucgccggcaacgccuucaccgccggcaagaucaucgucugcgccgucccccccaacuucccccccgaccgccucuccgccucccaggccaccaacuucccccacgucaucauggacguccgcacccucgagcccgucauccucccccuccccgacguccgcgccggcuucuuccacuacaaccagcuccgcgagccccgcaugcgccucauggcccuccucuacaccccccuccgcgccaacggcaccggcgacgacgccuucaccgucuccugccgcguccucacccgccccaugcaggacuucgaguucauguuccucgucccccccaccgucgagucccgcgucacccccuucuccguccccaccuaccccgucgucgagaugaccaacucccgcuggcccgcccgcaucuccggcaugcacgucaacgccaaccagacccucgccguccaguuccagaacggccgcugcacccucgacggccagcucaugggcaccacccagcucugcgccgccgacgucugccgcaugcgcggccgcuacaccuccacccgcgccgaccucgccggcgucgaccacaccgaccagggccccucccucggcgccggccccuccaacgaccccgucuccguccccgaggcccgcucccagacccgcaccuccgucuccgcccaccuccagcucgaggagcucaacggccagcccuacgaggucuacggcgagcagcccgccccccucggcacccccgacuucugcugccgccucaugggcgagcucguccgccuccccuccaccucccccgccgcccagucccgcuuccgcgacgccuucuucgacaccuacggcgcccucuucgcccccgccgucggcuccaccaccuucaccgucaacaacuccuccaccuccgacuucgccaacggccagcccuucgaguuccuccccaucggcgucgagaucggcaacuccgcccaguacgacgaguucgcccuccccuccuacaacggcgccaucggcgagaaccgccaccucgcccccgucgccgcccccggcuuccccggcgagaacaucgucuucuucuccuccaaccuccccgucugggacuccaccuccgcccagaacaaccgccgcaucuccugccuccuccccaacgaguucguccagcacuucuacgaccuccaggcccccucccaguccgacgucgcccuccuccgcuacguccaccccgaguccggccgcguccucuucgagugcaagcucuaccgcgacggcuuccucaccgucaacggcgccucccucgccgaguuccccgucaacggcuacuuccgcuucgacuccugggucaaccaguucuucacccucucccccgucggcaccggcuccggccgcuga

SEQ ID NO: 15594 - RNA, 1719 nt, Artificial Sequence
  derived and/or modified sequence opt2 from VP1__Norovirus_and/or_Norovirus-like__EU224456
augaagauggccuccaacgacgccgcccccuccuccgacggcgccggcaaccucguccccgagucccaccaggagguccucccccucgcccccgucgccggcgccgccaucgccgcccccgucgucggccagcagaacaucaucgaccccuggaucaaggagaacuucguccaggccccccagggcgaguucaccgucucccccaagaacucccccggcgagguccucgucaaccucgagcucucccccaagcucaaccccuaccucgaccaccucuccaagauguacaacgccuacgccggcggcauggagaucgagaucauccucgccggcaacgccuucaccgccggcaagguccucaucgccgccgucccccccaacuuccccgucgagaacaucuccgucucccaggccucccaguucccccacgucaucgucgacguccgcacccucgagcccauccgccucccccuccccgacguccgcaccaacuucuuccacuacaccacccgcgacgagcccaagaugcgcaucgucgccuggcucuacaccccccuccgcaccaacggcuccggcgacgacuccuucaccgucuccggccgcauccucacccgccccuccgccgacuucgaguucuccuuccucgucccccccaccgucgagaccaagaccgucuccuucuccguccccggccucaccgucgaggagauguccaacucccgcuggcccgcccagaucaacggccucgucguccgcggcaacgaggcccaggucguccacuuccagaacggccgcugcaccaccgagggcaugcuccucggcaccaccacccucaacgucaacuccaucugcggccuccgcggcaccuccaucucccacgccuccguccgcgaggcccccgcccucuccgaggagaugcccccccucgaggacgaggucgcccacggcgccgccgccaccuacgccgucggccgcgccgccgacaccacccucuggauccgcgucgaggagcccaacggccagcccuacgacaucuucggcgagcagcccgccccccucggcacccccgacuucaccgccgucaucaucggcaccgccauccgcccccgcaccgccuccggcgccuaccuccacgacgccuacgucgacacccgccccggcgacgccgacuucacccccuccaccggcaacaccaagaucguccuccgcggcggcggcuccggccacgucggcgagggccacuacuggcaguucaagcccaucgccgucgagggcggccccaaccgccccgucuaccaggaguacaaccuccccgaguacgccggccccaccgccuccaaccacaaccucgccccccccgucgcccccaagaugcccggcgagcuccuccuccucuucgaguccgacaugcccgucugggacaacggcuccggcuccgcccccacccagaagauccacugccuccuccccaacgacuucgucacccacuucuucgaccuccaggcccccgcccucgccgaggccgcccuccuccgcuacguccaccccgacuccggccgcacccucuucgagugcaagcucuaccgcgagggcuacauggucgucgucgcccccuccggccgccucgacuucccccucgacggcuacuuccgcuucgacuccugggucaacgccuucuacguccucucccccgucggcaacggccagggccgccgcuga

SEQ ID NO: 15595 - RNA, 1719 nt, Artificial Sequence
  derived and/or modified sequence opt2 from VP1__Norovirus_and/or_Norovirus-like__EF450827
augaagauggccuccuccgacgccacccccuccuccgacggcgccggcaaccucguccccgagucccagcaggagguccucccccucgcccccgucgccggcgccgcccucgccgcccccgucgucggccagcagaacaucaucgaccccuggaucaaggagaacuucguccaggccccccagggcgaguucaccgucucccccaagaacucccccggcgagguccucgucaaccucgagcucuccccccgccucaaccccuaccuccaccaccucuccaagauguacaacgccuacgccggcggcauggaggucgagaucauccucgccggcaacgccuucaccgccggcaagguccucaucgccgccgucccccccaacuuccccaucgagaacgucuccgccucccaggccucccaguucccccacgucaucgucgacguccgcacccucgagcccauccgccucccccuccccgacguccgcaccaacuucuuccacuacaccacccaggaggagccccgcaugcgcaucgucgccuggcucuacaccccccuccgcaccaacggcuccggcgacgacuccuucaccgucuccggccgcauccucacccgccccucccccgacuucgaguucuccuuccucgucccccccaccgucgagaccaagaccgucuccuucuccguccccggccucgucguccaggacauguccaacucccgcuggcccgcccagaucuccggccucgucguccgcggcaacgaggcccaggucguccacuuccagaacggccgcugcaccaccgagggcaugcuccucggcaccaccacccucaacaucaacuccaucugcggccuccgcggccucuccgucucccaggccuccguccgcggcgcccccgcccucaccgaggagaugcccccccucgaggacgaggucgccgacggcgccgccgccaccuacacccucacccgcgccgccgacaccgcccucuggcuccgcgucgaggagcccgacggccgccccuacgacaucuucggcgaccagcccgccccccucggcacccccgacuucaccgccgucaucgucggcaccgccauccgcccccgcaccaccuccggcgccuaccuccacgacgccuacgucgacaccacccccggcgacgccgacuucacccccuccaccggcaacaccaagaucguccuccgcggcggcggcuccggccacgucggccagggccacuacuggcaguucaagcccaucgccgucgagggcggcggcucccgcccccaguaccaggaguacaaccuccccgacuacgccggccccaccgccuccaaccacgaccucgccccccccgucgccccccgcaugcccggcgagcuccuccuccucuucgaguccgacaugcccgucugggacaacggcgccggcgccgcccccgcccagaagauccacugccuccuccccaacgaguucaucacccaccucuucgaccuccaggcccccgcccucgccgaggccgcccuccuccgcuacguccaccccgacuccggccgcacccucuucgagugcaagcucuaccgcgagggcuacauggucgucgccgcccccgucggccgccucaacuucccccucgacggcuacuuccgcuucgacuccugggucuccgccuucuacguccucucccccgucggcuccggccagggccgccgcuga

SEQ ID NO: 15596 - RNA, 1719 nt, Artificial Sequence
  derived and/or modified sequence opt2 from VP1__Norovirus_and/or_Norovirus-like__JF781268
augaagauggccuccuccgacgccacccccuccuccgacggcgccggcaaccucguccccgagucccagcaggagguccucccccucgcccccgucgccggcgccgcccucgccgcccccgucgucggccagcagaacaucaucgaccccuggaucaaggagaacuucguccaggccccccagggcgaguucaccgucucccccaagaacucccccggcgagguccucgucaaccucgagcucuccccccgccucaaccccuaccucgaccaccucuccaagauguacaacgccuacgccggcggcauggaggucgagaucauccucgccggcaacgccuucaccgccggcaagguccucaucgccgccgucccccccaacuuccccaucgagaacaucuccgccucccaggccucccaguucccccacgucaucgucgacguccgcacccucgagcccauccgccucccccuccccgacguccgcaccaacuucuuccacuacaccacccaggaggagccccgcaugcgcaucgucgccuggcucuacaccccccuccgcaccaacggcuccggcgacgacuccuucaccgucuccggccgcauccucacccgccccucccccgacuucgaguucuccuuccucgucccccccaccgucgagaccaagaccgucuccuucuccguccccggccucgucgucgaggacauguccaacucccgcuggcccgcccagaucaacggccucgucguccgcggcaacgaggcccaggucguccacuuccagaacggccgcugcaccaccgagggcacccuccucggcaccaccacccucuccaucaacuccaucugcggccuccgcggccucuccgucucccaggccuccguccgcggcgcccccgcccucaccgaggagaugcccccccucgaggacgaggucgccgacggcgccgccgccaccuacacccucgcccgcgccgccgacaccacccucuggcuccgcgucgaggagcccgacggccgccccuacgacaucuucggcgaccagcccgccccccucggcacccccgacuucaccgccgucaucgucggcaccgccauccgcccccgcaccgccuccggcgccuaccuccacgacgccuacgucgacaccacccccggcgacgccgacuucacccccuccaccggcaacaccaagaucguccuccgcggcggcggcuccggccacgucggccagggccacuacuggcaguuccgccccaucgccgucgagggcggcggcucccgcccccaguaccaggaguacaaccuccccgacuacgccggccccaccgccuccaaccacgaccucgccccccccgucgccccccgcaugcccggcgagcuccuccuccucuucgaguccgacaugcccgucugggacaacggcgccggcgccgcccccgcccagaagauccacugccuccuccccaacgaguucaucacccaccucuucgaccuccaggcccccgcccucgccgaggccgcccuccuccgcuacguccaccccgacuccggccgcacccucuucgagugcaagcucuaccgcgagggcuacauggucgucgccgcccccgccggccgccucaacuucccccucgacggcuacuuccgcuucgacuccugggucuccgccuucuacauccucucccccgucggcuccggccagggccgccgcuga

SEQ ID NO: 15597 - RNA, 1698 nt, Artificial Sequence
  derived and/or modified sequence opt2 from VP1__Norovirus_and/or_Norovirus-like__KT245136
augaagauggccuccaacggcgccgccgcccccucccaggacggcgccgccaaccucguccccgagucccagcaggagguccucgcccucgagcccgucgccggcgccgcccucgccgcccccgucgccggccaguucaacgccaucgaccccuggaucaagcagaacuucguccaggcccccgccggcgaguucaccgucuccccccgcaacgcccccggcgagguccucauggaccucgagcucggccccgagaugaaccccuuccucgcccaccucgcccagauguacaacgccuacgccggcggcauggagguccagaucauccucgccggcaacgccuucaccgccggcaagaucaucgucugcgccgucccccccaacuucccccccgaccgccucuccgccucccaggccaccaacuucccccacgucaucauggacguccgcacccucgagcccgucguccucccccuccccgacguccgcgccggcuucuuccacuacaaccagcuccgcgagccccgcaugcgccucaugacccuccucuacaccccccuccgcgccaacggcaccggcgacgacgccuucaccgucuccugccgcguccucacccgccccaugcucgacuucgaguucauguuccucgucccccccaccgucgagucccgcgucacccccuucuccguccccaccuaccccgucgucgagaugaccaacucccgcuggcccgcccgcaucuccggcaugcacgucaacgccaaccagacccucgccguccaguuccagaacggccgcugcacccucgacggccagcucaugggcaccacccagcucugcgccgccgacgucugccgcaugcgcggccgcuacaccuccacccgcgccgaccccgccggccucggcugggaccucgacgccaccacccucgucgacggccccgaggcccgcguccaggcccgcaucuccgucuccgcccaccuccagcucgaggagcucuccggccagcccuacgaggucuacggcgagcagcccgccccccucggcacccccgacuuccagugccgccucaugggcgagcucguccgccuccccuccgccaaccccgucgcccagucccgcuuccgcgacgccuucuucgacaccuacggcgcccucuucgcccccgccgucggcuccgucaccgucaccgucaacaacuccuccuccuccgacuucgccaacgaccagcccuucgaguuccuccccaucggcgucgagaucggcaacuccgcccgcuacgacgaguucgcccuccccuccuacaacggcgccaucggcgagaaccgccaccucgcccccaucgccgcccccggcuuccccggcgagaaccucaucuucuucuccuccaaccuccccgucugggacuccaccuccgcccaguccaaccgccgcaucuccugccuccuccccaacgaguucauccagcacuucuacgaccuccaggcccccucccaguccgacgucgcccuccuccgcuacguccaccccgagaccgaccgcuuccucuucgagugcaagcucuaccgcgacgccuuccucaccgucaacggcgccuccuacgccgaguuccccgucaacggcuacucccgcuucgacuccugggucaagcaguucuucacccucucccccgucggcaccggcuccggccgccgcuga

SEQ ID NO: 15598 - RNA, 1659 nt, Artificial Sequence
  derived and/or modified sequence opt2 from VP1__Norovirus_and/or_Norovirus-like__AJ844470
augaagauggccuccaaggacgccucccccuccaccgacggcgccgccaaccucguccccgagucccagcaggagguccucgcccuccagcccgucgccggcgcccagaucgccgcccccgucgccggccaguucaacgucaucgaccccuggaucuaccagaacuucguccaggcccccgagggcgaguucaccgucuccccccgcaacuccaccggcgagauccucaugaaccucgagcucggcccccagcucaaccccuaccucgcccaccucgcccgcauguacaacgccuacgccggcggcuucgagguccagguccuccucgccggcaacgccuucaccgccggcaagaucaucgucugcgccgucccccccaacuucccccuccagaacaucuccgccgcccaggccacccagcucccccacgucgucgucgacguccgccagcucgagcccgucguccucccccuccccgacguccgcgccggcuucuaccacuacaaccaggucgaggagucccgcaugcgccucgucgccauccucuacaccccccuccgcaccaacuccgccggcgacgacgccuucaccgucuccugccgcauccucacccgccccgcccccgacuucuccuucuucuuccucaucccccccaccaucgaguccaagaccacccccuucacccucccccgccuccccaucuccgagaugaccaacucccgcuucccccucgucaucaagggcauggucgucgaccccaaccucccccuccaggccaacuuccagaacggccgcaucacccucgacggcgagcuccagggcaccacccuccccaccuccaccuccaucggccgcaucuccggcaccuacauguccuccacccccucccgcaucauccagcacgaggacuccggcgacuccacccagccccgcgucuucaaccccgucuggauggaccucaccgagaacaacuggaccgaguuccagcccuucaacgaccagcccgccccccucggcugccccgacuucaaggccaagauccucggcacccucauccgccagcccaacaacggcuccuacuacuucgacgccuaccucgacacccgccagcacggcaccuucgcccccuacaccggccacgccgccguccacuccgaccagcaggccggccaccucgcccagggcuacaagauccaguucucccccaccggcaucgaguccgaccagaacaccgaccucaaccagcuccccgacuacggcggcgccaugaccgucuccaagggccucgcccccgccgccgcccccgacuuccccggcgagaugauccucuacuucgucuccgacaugcccguccgcaaccccaacggcgagcgccgcgacaccgagauccucugccuccucccccaggagauggucacccacuucuacgagcagcaggcccccucccagggcgacgucgcccucguccgcuacaucaacgccgagaccggccgcgucauguucgagggcaagcuccaccgcaacggcuucuucaccgucuccgccaccgcccgcacccucaucguccccgacggcuacuuccgcuucgacuccugggucaaccgcuucuacacccucucccccaugggcaccggcaacggccgccgccgcgcccgcuga

SEQ ID NO: 15599 - RNA, 1659 nt, Artificial Sequence
  derived and/or modified sequence opt2 from VP1__Norovirus_and/or_Norovirus-like__KJ196291
augaagauggccuccaaggacgccucccccuccaccgacggcaccgccaaccucguccccgagucccagcaggagguccucgcccuccagcccgucgccggcgcccagaucgccgcccccgucgccggccaguucaacgucaucgaccccuggaucuaccagaacuucguccaggcccccgagggcgaguucaccgucuccccccgcaacuccaccggcgagauccucaugaaccucgagcucggcccccagcucaaccccuaccucgcccaccucgcccgcauguacaacgccuacgccggcggcuucgagguccagguccuccucgccggcaacgccuucaccgccggcaagaucaucgucugcgccgucccccccaacuucccccuccagaacaucuccgccgcccaggccacccagcucccccacgucgucgucgacguccgccagcucgagcccgucguccucccccuccccgacguccgcgccggcuucuaccacuacaaccaggucgaggagucccgcaugcgccucgucgccauccucuacaccccccuccgcaccaacuccgccggcgacgacgccuucaccgucuccugccgcauccucacccgccccgcccccgacuucuccuucuucuuccucaucccccccaccaucgaguccaagaccacccccuucacccucccccgccuccccaucuccgagaugaccaacucccgcuucccccucgucaucaagggcauggucgucgaccccaaccucccccuccaggccaacuuccagaacggccgcaucacccucgacggcgagcuccagggcaccacccuccccaccuccaccuccaucggccgcaucuccggcacccacauguccuccacccccucccgcaucauccagcacgaggacuccggcgacuccacccagccccgcgucuucaaccccgucuggauggaccucaccgagaacaacuggaccgaguuccagcccuucaacgaccagcccgccccccucggcugccccgacuucaaggccaagauccucggcacccucauccgccagcccaacaacggcuccuacuacuucgacgccuaccucgacacccgccagcacggcaccuucgcccccuacaccggccacgccgccguccacuccgaccagcaggccggccaccucgcccagggcuacaagauccaguucucccccaccggcaucgaguccgaccagaacaccgaccucaaccagcuccccgacuacggcggcgccaugaccgucuccaagggccucgcccccgccgccgcccccgacuuccccggcgagaugauccucuacuucgucuccgacaugcccguccgcaaccccaacggcgagcgccgcgacaccgagauccucugccuccucccccaggagauggucacccacuucuacgagcagcaggcccccucccagggcgacgucgcccucguccgcuacaucaacgccgagaccggccgcgucauguucgagggcaagcuccaccgcaacggcuucuucaccgucuccgccaccgcccgcacccucaucguccccgacggcuacuuccgcuucgacuccugggucaaccgcuucuacacccucucccccaugggcaccggcaacggccgccgccgcgcccgcuga

SEQ ID NO: 15600 - RNA, 1653 nt, Artificial Sequence
  derived and/or modified sequence opt2 from VP1__Norovirus_and/or_Norovirus-like__KU870455
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaacgcccgcgccgccgaccucaccgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggcacccaggagcagggccacuacgccacccgcgcccacgaggcccacaucgacaccaccgaccccaaguacgcccccaagcucggcaccauccucaucaaguccgaguccaccgacuucaccaccaaccagcccauccgcuucacccccgucggcaugggcgacaacaacuggcgccagugggagcuccccgacuacuccggcucccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 15601 - RNA, 1653 nt, Artificial Sequence
  derived and/or modified sequence opt2 from VP1__Norovirus_and/or_Norovirus-like__AF414408
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacgucaagcagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccggcuccccccagcgcgcccgcaaccacccccuccacguccaggucaagaaccucgacggcacccaguacgaccccaccgacgacauccccgccguccucggcgccaucgacuucaagggcaccgucuucggcgucgccucccagcgcgacgucuccggccagcaggagcagggccacuacgccacccgcgcccacgaggcccacaucgacaccaccgaccccaaguacgcccccaagcucggcaccauccucaucaaguccgacuccgacgacuucaacaccaaccagcccauccgcuucacccccgucggcaugggcgacaacaacuggcgccagugggagcuccccgacuacuccggccaccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 15602 - RNA, 1653 nt, Artificial Sequence
  derived and/or modified sequence opt2 from VP1__Norovirus_and/or_Norovirus-like__AB084071
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggcccccaggagcagggccacuacgccacccgcgcccacgagacccacaucgacaccaccgaccccaaguacgcccccaagcucggcaccauccucaucaaguccgaguccaacgacuucaucaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 15603 - RNA, 1653 nt, Artificial Sequence
  derived and/or modified sequence opt2 from VP1__Norovirus_and/or_Norovirus-like__AF414407
augaagauggccuccaacgacgccgcccccuccaacgacggcgccgccaaccucguccccgaggccaacaacgaggucauggcccucgagcccgucgucggcgccuccaucgccgcccccgccgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccacccucacccucggcgagcucuccaacccccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcaaccacccccuccacguccaggucaagaaccucgacggcacccaguacgaccccaccgacgacauccccgccguccucggcgccaucgacuucaagggcaccgucuucggcgucgccucccagcgcgacgucuccggccagcaggagcagggccacuacgccacccgcgcccacgaggcccacaucgacaccaccgaccccaaguacgcccccaagcucggcaccauccucaucaaguccgacuccgacgacuucaacaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 15604 - RNA, 1653 nt, Artificial Sequence
  derived and/or modified sequence opt2 from VP1__Norovirus_and/or_Norovirus-like__AB039777
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccccauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccgucccccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcgaccacccccuccacguccaggucaagaaccucggcggcacccaguacgaccccaccgacgacauccccgccguccucggcgccaucgacuucaagggcaccgucuucggcgucgccucccagcgcgacgucuccggcccccaggagcagggccacuacgccacccgcgcccacgaggcccacaucgacaccaccgaccccaaguacgcccccaagcucggcaccauccucaucaaguccgaguccaacgacuucaccaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 15605 - RNA, 1653 nt, Artificial Sequence
  derived and/or modified sequence opt2 from VP1__Norovirus_and/or_Norovirus-like__AB078337
augaagauggccuccaacgacgccgcccccuccaacgacggcgccgccaaccucguccccgaggccaacgacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcaaccacccccuccacguccaggucaagaaccucgacggcacccaguacgaccccaccgacgacauccccgccguccucggcgccaucgacuucaagggcaccgucuucggcgucgccucccagcgcgacgucuccggccagcaggagcagggccacuacgccacccgcgcccacgaggcccacaucgacaccaccgaccccaaguacgcccccaagcucggcaccauccucaucaaguccggcuccgacgacuucaacaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacugcggcaacaaccccaucgucgucccccccaacggcuacuuccgcuucgaggccuggggcaaccaguucuacacccucgcccccaugggcuccggccagggccgccgccgcgcccaguga

SEQ ID NO: 15606 - RNA, 1653 nt, Artificial Sequence
  derived and/or modified sequence opt2 from VP1__Norovirus_and/or_Norovirus-like__AB039776
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccccauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccgucccccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggcccccaggagcagggccacuacgccacccgcgcccacgaggcccacaucgacaccaccgaccccaaguacgcccccaagcucggcaccauccucaucaaguccgaguccaacgacuucaccaccaaccagcccauccgcuucacccccgucggcaugggcgacaacaacuggcgccagugggagcuccccgacuacuccggccgccucgcccucaacaugaaccucgcccccgccgucucccccuccuuccccggcgagcgcauccucuucuuccgcuccaucguccccuccgccggcggcuacggcuccggcuacaucgacuaccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 15607 - RNA, 1653 nt, Artificial Sequence
  derived and/or modified sequence opt2 from VP1__Norovirus_and/or_Norovirus-like__KT030674
augaagauggccuccuccgacgccgcccccuccaccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccuccgaggccgacgagcgcgccgucggcuccuucgacgucuggguccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcaccggccacaucuccgccaacaaguacugggaguucaaguccuucggcgucgagggcgagcgccacaccgacauccaguaccaggaguacgagcuccccgacuacuccggccaggucgccuccaaccacaaccucgccccccccgucgccccccgcaugcccggcgagucccuccuccucuuccaguccaacaugcccgucugggacgacggccgcggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcuga

SEQ ID NO: 15608 - RNA, 1653 nt, Artificial Sequence
  derived and/or modified sequence opt2 from VP1__Norovirus_and/or_Norovirus-like__DQ093067
augaagauggccuccaacgacgccgcccccuccaccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucgucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccuccgaggccgacgagcgcgccgucggcuccuucgacgucuggguccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcaccggccacaucuccgccaacaaguacugggaguucaaguccuucggcgucgagggcgagggccacaccaacauccaguaccaggaguacgagcuccccgacuacuccggccaggucgccuccaaccacaaccucgccccccccgucgccccccgcaugcccggcgagucccuccuccucuuccaguccuccaugcccgucugggacgacggccacggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcuga

SEQ ID NO: 15609 - RNA, 1653 nt, Artificial Sequence
  derived and/or modified sequence opt2 from VP1__Norovirus_and/or_Norovirus-like__AF195847
augaagauggccuccuccgacgccgcccccuccgccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccucccccgaggccgacgagcgcgccgucggcuccuucgacgucuggauccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcuccggccacaucuccgccaacaaguacugggaguucaaguccuucggcgucgagggcgagcgccacaccgacauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcuga

SEQ ID NO: 15610 - RNA, 1653 nt, Artificial Sequence
  derived and/or modified sequence opt2 from VP1__Norovirus_and/or_Norovirus-like__JQ970479
augaagauggccuccuccgacgccgcccccuccgccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccuccgaggccgacgagcgcgccgucggcuccuucgacgucuggauccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcaccggccacaucuccgccaacaaguacugggaguuccgcuccuucggcgucgagggcgagcgccacaccgacguccaguaccaggaguacgagcuccccgacuacuccggccaggucgccuccaaccacaaccucgccccccccgucgccccccgcaugcccggcgagucccuccuccucuuccaguccaacaugcccgucugggacgacggccgcggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccgccuccggccuccucgacuucccccucgacggcuucuuccgcuucgacuccugggucuccuccuucuacauccucucccccgucggcuccggccagggccgccgcuga

SEQ ID NO: 15611 - RNA, 1653 nt, Artificial Sequence
  derived and/or modified sequence opt2 from VP1__Norovirus_and/or_Norovirus-like__FM865412
augaagauggccuccuccgacgccgcccccuccaccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccuccgaggccgacgagcgcgccgucggcuccuucgacgucuggguccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcaccggccacaucuccgccaacaaguacugggaguucaaguccuucggcgucgagggcgagcgccacaccaacauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcuga

SEQ ID NO: 15612 - RNA, 1653 nt, Artificial Sequence
  derived and/or modified sequence opt2 from VP1__Norovirus_and/or_Norovirus-like__AF414426
augaagauggccuccuccgacgccgcccccuccaccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccuccgaggccgacgagcgcgccgucggcuccuucgacgucuggguccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcaccggccacaucuccgccaacaaguacugggaguucaaguccuucggcgucgagggcaagcgccacaccuccauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcuga

SEQ ID NO: 15613 - RNA, 1653 nt, Artificial Sequence
  derived and/or modified sequence opt2 from VP1__Norovirus_and/or_Norovirus-like__AF414427
augaagauggccuccuccgacgccgcccccuccgccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccaccgaggccgacgagcgcgccgucggcuccuucgacgucuggauccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcuccggccacaucuccgccaacaaguacugggaguucaaguccuucggcgucgagggcgagcgccacaccgacauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcuga

SEQ ID NO: 15614 - RNA, 1653 nt, Artificial Sequence
  derived and/or modified sequence opt2 from VP1__Norovirus_and/or_Norovirus-like__JQ613567
augaagauggccuccuccgacgccgcccccuccaccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccuccgaggccgacgagcgcgccgucggcuccuucgacgucuggguccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcaccggccacaucuccgccaacaaguacugggaguucaaguccuucggcgucgagggcgagcgccacaccgacauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgaccgccaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcuga

SEQ ID NO: 15615 - RNA, 1653 nt, Artificial Sequence
  derived and/or modified sequence opt2 from VP1__Norovirus_and/or_Norovirus-like__KC894731
augaagauggccuccuccgacgccgcccccuccaccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgaggucgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccucccccgaggccgacgagcgcgccgucggcuccuucgacgucuggguccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccaacuacgcccccgccaccggcaacaugcgcuucaccguccgcaacggcggcaccggccacaccuccgccaacaaguacugggaguucaaguccuucggcgucgagggcgagcgccacaccggcauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcuga

SEQ ID NO: 15616 - RNA, 1647 nt, Artificial Sequence
  derived and/or modified sequence opt2 from VP1__Norovirus_and/or_Norovirus-like__AF427118
augaagauggccuccaacgacgccgcccccuccuccgacggcgccgccggccucguccccgaguccaacaacgaggucauggcccucgagcccgucgccggcgccucccucgccgcccccgucaccggccagaccaacaucaucgaccccuggauccgcaugaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcauggagguccagaucaugcucgccggcaacgccuucaccgccggcaagcucaucuucgccgccguccccccccacuuccccaucgagaaccucucccccccccagaucaccauguucccccacgucaucaucgacguccgcacccucgagcccguccuccuccccaugcccgacauccgcaacuccuucuuccacuucauccagcgcgacgagcccaagaugcgccucgucgccaugcucuacaccccccuccgcuccaacggcuccggcgacgacgucuucaccgucuccugccgcguccucacccgccccacccccgacuucgacuucaccuaccucgucccccccaccgucgaguccaaguccaagcccuucacccuccccauccucacccucggcgagcucaccaacucccgcuucccccuccccaucgacguccucuacaccaaccccaacgaguccgccaucguccagugccagaacggccgcugcacccucgacggcgagcuccagggcaccacccagcuccuccccaccggcaucugcgccuuccgcggcaaggucacccagcagguccaggacgagcaccgcggcacccacuggaacaugaccgucaccaaccucaacggcacccccuucgaccccaccgaggacguccccgccccccucggcacccccgacuucuccggccagaucuacggcgucaucucccagcgcaacaccaacaccguccccggcgagggcgaccuccccgccaaccgcgcccacgaggccgucaucgccaccuacucccccaaguucacccccaagcucggcaacauccaguucuccaccugggagacccaggacgucuccuccggccagcccaccaaguucacccccgucggccucgccuccgucgacgccaacucccacuucgaccaguggacccuccccuccuacuccggcgcccucacccucaacaugaaccucgcccccuccgucgcccccgucuuccccggcgagugccuccucuucuuccgcuccuucaucccccucaagggcggcuacggcaaccccgccaucgacugccucaugccccaggaguggguccagcaccucuaccaggaguccgcccccucccucuccgacgucgcccucguccgcuacgucaaccccgagaccggccgcacccucuucgaggccaagcuccaccgcaacggcuuccucaccgucgcccgcaacuccgccggccccgucgucgcccccaccaacggcuacuuccgcuucgacuccugggucaaccaguucuacacccucgcccccaugggcaacggcuccggccgccgccgcaugcaguga

SEQ ID NO: 15617 - RNA, 1647 nt, Artificial Sequence
  derived and/or modified sequence opt2 from VP1__Norovirus_and/or_Norovirus-like__AY237415
augaagauggccuccaacgacgccgcccccuccuccgacggcgccgccggccucguccccgaguccaacaacgaggucauggcccucgagcccgucgccggcgccucccucgccgcccccgucaccggccagaccaacaucaucgaccccuggauccgcaugaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcauggagguccagaucaugcucgccggcaacgccuucaccgccggcaagcucaucuucgccgccguccccccccacuuccccaucgagaaccucucccccccccagaucaccauguucccccacgucaucaucgacguccgcacccucgagcccguccuccuccccaugcccgacauccgcaacuccuucuuccacuucauccagcgcgacgagcccaagaugcgccucgucgccaugcucuacaccccccuccgcuccaacggcuccggcgacgacgucuucaccgucuccugccgcguccucacccgccccacccccgacuucgacuucaccuaccucgucccccccaccgucgaguccaaguccaagcccuucacccuccccauccucacccucggcgagcucaccaacucccgcuucccccuccccaucgacguccucuacaccaaccccaacgaguccgccaucguccagugccagaacggccgcugcacccucgacggcgagcuccagggcaccacccagcuccuccccaccggcaucugcgccuuccgcggcaaggucacccagcagguccaggacgagcaccgcggcacccacuggaacaugaccgucaccaaccucaacggcacccccuucgaccccaccgaggacguccccgccccccucggcacccccgacuucuccggccagaucuacggcgucaucucccagcgcaacaccaacaccguccccggcgagggcaaccuccccgccaaccgcgcccacgaggccgucaucgccaccuacucccccaaguucacccccaagcucggcaacauccaguucuccaccugggagacccaggacgucuccuccggccagcccaccaaguucacccccgucggccucgccuccgucgacgccaacucccacuucgaccaguggacccuccccuccuacuccggcgcccucacccucaacaugaaccucgcccccuccgucgcccccgucuuccccggcgagugccuccucuucuuccgcuccuucaucccccucaagggcggcuacggcaaccccgccaucgacugccucaugccccaggaguggguccagcaccucuaccaggaguccgcccccucccucuccgacgucgcccucguccgcuacgucaaccccgagaccggccgcacccucuucgaggccaagcuccaccgcaacggcuuccucaccgucgcccgcaacuccgccggccccgucgucgcccccaccaacggcuacuuccgcuucgacuccugggucaaccaguucuacacccucgcccccaugggcaacggcuccggccgccgccgcaugcaguga

SEQ ID NO: 15618 - RNA, 1647 nt, Artificial Sequence
  derived and/or modified sequence opt2 from VP1__Norovirus_and/or_Norovirus-like__AF504671
augaagauggccuccaacgacgccgcccccuccaacgacggcgccgccggccucguccccgaguccaacaacgaggucauggcccucgagcccgucgccggcgccucccucgccgcccccgucaccggccagaccaacaucaucgaccccuggauccgcaugaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcauggagguccagaucaugcucgccggcaacgccuucaccgccggcaagcucaucuucgccgccguccccccccacuuccccaucgagaaccucucccccccccagaucaccauguucccccacgucaucaucgacguccgcacccucgagcccguccuccuccccaugcccgacauccgcaacuccuucuuccacuucauccagcgcgacgagcccaagaugcgccucgucgccaugcucuacaccccccuccgcuccaacggcuccggcgacgacgucuucaccgucuccugccgcguccucacccgccccacccccgacuucgacuucaccuaccucgucccccccaccgucgaguccaaguccaagcccuucacccuccccauccucacccucggcgagcucaccaacucccgcuucccccuccccaucgacguccucuacaccaaccccaacgaguccgccaucguccagugccagaacggccgcugcacccucgacggcgagcuccagggcaccacccagcuccuccccaccggcaucugcgccuuccgcggcaaggucacccagcagguccaggacgagcaccgcggcacccacuggaacaugaccgucaccaaccucaacggcacccccuucgaccccaccgaggacguccccgccccccucggcacccccgacuucuccggccagaucuacggcgucaucucccagcgcaacaccaacaccguccccggcgagggcaaccuccccgccaaccgcgcccacgaggccgucaucgccaccuacucccccaaguucacccccaagcucggcaacauccaguucuccaccugggagacccaggacgucuccuccggccagcccaccaaguucacccccgucggccucgccuccgucgacgccaacucccacuucgaccaguggacccuccccuccuacuccggcgcccucacccucaacaugaaccucgcccccuccgucgcccccgucuuccccggcgagugccuccucuucuuccgcuccuucaucccccucaagggcggcuacggcaaccccgccaucgacugccucaugccccaggaguggguccagcaccucuaccaggaguccgcccccucccucuccgacgucgcccucguccgcuacgucaaccccgagaccggccgcacccucuucgaggccaagcuccaccgcaacggcuuccucaccgucgcccgcaacuccgccggccccgucgucgcccccaccaacggcuacuuccgcuucgacuccugggucaaccaguucuacacccucgcccccaugggcaacggcuccggccgccgccgcaugcaguga

SEQ ID NO: 15619 - RNA, 1647 nt, Artificial Sequence
  derived and/or modified sequence opt2 from VP1__Norovirus_and/or_Norovirus-like__KJ194504
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaccccccgccaguucgaccaccgcuggcacauccagcucgacaaccucaacggcacccccuacgaccccgccgaggacauccccgccccccucggcacccccgacuuccgcggcaaggucuucggcgucgccucccagcgcaaccccgacggcaccacccgcgcccacgaggccaaggucgacaccaccaccaaccgcuucacccccaagcucggcucccucgagaucaucaccgaguccgaggacuucgacaccaaccaguccaccaaguucacccccgucggcgucggcgucgacaacgaggaggaguuccagcaguggucccuccccaacuacuccggccaguucacccacaacaugaaccucgcccccgccgucgcccccaacuuccccggcgagcagcuccucuucuuccgcucccagcuccccuccuccggcggcugguccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15620 - RNA, 1647 nt, Artificial Sequence
  derived and/or modified sequence opt2 from VP1__Norovirus_and/or_Norovirus-like__KJ194500
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucucccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccaguccuccgagucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucaccggcuccaccucccgcgccuccgaccagaccgacacccccaccccccgccaguucgaccgccgcuggcacauccagcucgacaaccucaacggcacccccuacgaccccgccgaggacauccccgccccccucggcacccccgacuuccgcggcaaggucuucggcgucgccucccagcgcaaccccgaccgcgccacccgcgcccacgaggccaaggucgacaccaccuccgaccgcuucgcccccaagcucggcucccucgagaucaccaccgaguccggcgacuucgaggccaaccagcccaccaaguucacccccgucggcaucggcgucgacaacgaggccgaguuccagcaguggucccuccccaacuacuccggccagaucacccacaacaugaaccucgcccccgccgucgcccccaacuuccccggcgagcagcuccucuucuuccgcucccagcuccccuccuccggcggcugguccaacggcguccucgacugccuccucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15621 - RNA, 1647 nt, Artificial Sequence
  derived and/or modified sequence opt2 from VP1__Norovirus_and/or_Norovirus-like__DQ093063
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgaguccgucgucguccagugccagaacggccgcgucacccucgacggcgagcucaugggcaccacccagcuccuccccucccagaucugcgccuuccgcggcacccucacccgccccaccaaccgcgccuccgaccaggccgacaccgccaccccccgccucuucaaccaccaguggcacauccagcucgacaaccucaacggcacccccuacgaccccgccgaggacauccccgccccccucggcacccccgacuuccgcggcaaggucuucggcgucgccucccagcgcgaccccgacggcaccacccgcgcccacgaggccaaggucgacaccaccuccggccgcuucacccccaagcucggcucccucgagaucaccaccgaguccgacgacuucaaccagaacaagcccacccgcuucacccccgucggcaucggcgucgacaacgaggccgacuuccagcaguggauccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagaugggcuucaugaccaucgccaagaacggcgacucccccaucaccgucccccccaacggcuacuuccgcuucgaguccugggucaaccccuucuacacccucgcccccaugggcaccggcaagggccgccgccgcauccaguga

SEQ ID NO: 15622 - RNA, 1647 nt, Artificial Sequence
  derived and/or modified sequence opt2 from VP1__Norovirus_and/or_Norovirus-like__AY030313
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgaguccaucgucguccagugccagaacggccgcgucacccucgacggcgagcucaugggcaccacccagcuccuccccaaccagaucugcgccuuccgcggcacccucacccgcuccaccaaccgcgccuccgaccaggccgacaccgccaccccccgccucuucgaccaccacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaccaccgaguccgacgacuucgaccccaaccaguccaccaaguucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15623 - RNA, 1647 nt, Artificial Sequence
  derived and/or modified sequence opt2 from VP1__Norovirus_and/or_Norovirus-like__U02030
augaagauggccuccaacgacgccgcccccuccaacgacggcgccgccugccucguccccgagaucaacaacgaggccauggcccucgagcccgucgccggcuccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaccaccgaguccgacgacuucgaccccaaccagcccaccaaguucacccccgucggcgucggcgucgacaacgaggccgaguuccagcaguggucccuccccaacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15624 - RNA, 1647 nt, Artificial Sequence
  derived and/or modified sequence opt2 from VP1__Norovirus_and/or_Norovirus-like__AB039782
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcucuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaccccccgccucuucaaccaccgcuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaccaccgaguccgacgacuucgacaccaaccaguccaccaaguucacccccgucggcaucggcgucgacaacgaggccgaguuccagcaguggucccuccccaacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15625 - RNA, 1647 nt, Artificial Sequence
  derived and/or modified sequence opt2 from VP1__Norovirus_and/or_Norovirus-like__U46039
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuucaccccccuccgcgccaacaacuccggcgacgacgucuucaccgucuccugccgcguccucacccgccccucccccgacuucuccuucaacuuccucgucccccccaccgucgaguccaagaucaagcccuucacccuccccauccuccccaucuccgagauguccaacucccgcuuccccguccccaucgacucccuccacaccucccccaccgagaacaucgucguccagugccagaacggccgcgucacccucgacggcgagcucaugggcaccacccagcucuuccccucccagaucugcgccuuccgcggcacccucacccgcuccaccucccgcgccuccgaccaggccgacaccuccaccccccgccucuucaacuacuacuggcacauccagcucgacaaccucaacggcacccccuacgaccccgccgaggacauccccgccccccucggcacccccgacuuccagggcaaggucuucggcgucgccucccagcgcaaccccgacuccaccacccgcgcccacgaggccaaggucgacaccaccuccggccgcuucacccccaagcucggcucccucgagaucuccaccgaguccgacgacuucgacuccaaccagcccaccaaguucacccccgucggcaucggcgucgacaacgaggccgacuuccagcaguggucccuccccaacuacuccggccaguucacccacaacaugaaccucgcccccgccgucgcccccaucuuccccggcgagcagauccucuucuuccgcucccagguccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15626 - RNA, 1647 nt, Artificial Sequence
  derived and/or modified sequence opt2 from VP1__Norovirus_and/or_Norovirus-like__DQ093066
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcaccuuccgcggcacccucacccgcuccaccucccgcgccuccgaccaggccgacaccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucauccccaagcucggcucccucgagaucuccaccgaguccgacgacuucgaccagaaccagcccacccgcuucacccccgucggcaucggcgucgacaacgaggccggcuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucuccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15627 - RNA, 1647 nt, Artificial Sequence
  derived and/or modified sequence opt2 from VP1__Norovirus_and/or_Norovirus-like__DQ093062
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcucuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgccccaccucccgcgccuccgaccaggccgacacccccaccccccgccucuucaaccaccgcuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaccaccgaguccgacgacuucgacaccaaccaguccaccaaguucacccccgucggcaucggcgucgacaacgaggccgaguuccagcaguggucccuccccaacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucgucaaguacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15628 - RNA, 1647 nt, Artificial Sequence
  derived and/or modified sequence opt2 from VP1__Norovirus_and/or_Norovirus-like__GU930737
augaagauggccuccaacgacgccgcccccuccaacgacggcgccgccaaccucguccccgaggccaacuccgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccgaggagggcgccacccgcgcccacgagguccacaucgacaccaccaacccccgcuacacccccaagcucggcuccgucuucaugcacuccgaguccaccgacuucgacgacggccagcccacccgcuucacccccaucggcaugggcgccgacgacuggcgccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15629 - RNA, 1647 nt, Artificial Sequence
  derived and/or modified sequence opt2 from VP1__Norovirus_and/or_Norovirus-like__AF414412
augaagauggccuccaacgacgccgcccccuccuccgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcucuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccgacgacuucgaccccaaccagcccaccaaguucacccccgucggcaucggcgucgacaacgaggccgacuuccagcaguggucccuccccaacuacuccggccaguucacccacaacaugaaccucgcccccgccgucgcccccaacuuccccggcgagcagcuccucuucuuccgcucccagcgccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15630 - RNA, 1647 nt, Artificial Sequence
  derived and/or modified sequence opt2 from VP1__Norovirus_and/or_Norovirus-like__AB039781
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcucuucacccuccccauccucaccaucuccgagauguccaacucccgcuuccccguccccaucgacucccuccacaccucccccaccgagaacaucgucguccagugccagaacggccgcgucacccucgacggcgagcucaugggcgccacccagcuccuccccucccagaucugcgccuuccgcggcacccucacccgcuccaccucccgcgccuccgaccagaccgacacccccaccccccgccucuucaaccaccgcuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaccaccgaguccgacgaccucgacaccaaccaguccaccaaguucacccccgucggcaucggcgucgacaacgaggccgaguuccagcaguggucccuccccaacuacuccggccaguucacccacaacaugaaccucgcccccgccgucgcccucaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15631 - RNA, 1647 nt, Artificial Sequence
  derived and/or modified sequence opt2 from VP1__Norovirus_and/or_Norovirus-like__LC035073
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgaguucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcguccaguga

SEQ ID NO: 15632 - RNA, 1647 nt, Artificial Sequence
  derived and/or modified sequence opt2 from VP1__Norovirus_and/or_Norovirus-like__AF539440
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcgucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15633 - RNA, 1647 nt, Artificial Sequence
  derived and/or modified sequence opt2 from VP1__Norovirus_and/or_Norovirus-like__AF414414
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcucuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaccccccgccucuucaaccaccgcuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaucaccgaguccgacgacuucgacaccaaccaguccaccaaguucacccccgucggcaucggcgucgacaacgaguccgaguuccagcaguggucccuccccaacuacuccggccaguucacccacaacaugaaccucgcccccgccgucgcccccaacuuccucggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15634 - RNA, 1647 nt, Artificial Sequence
  derived and/or modified sequence opt2 from VP1__Norovirus_and/or_Norovirus-like__AB190457
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15635 - RNA, 1647 nt, Artificial Sequence
  derived and/or modified sequence opt2 from VP1__Norovirus_and/or_Norovirus-like__AF425768
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucuccggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcgucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15636 - RNA, 1647 nt, Artificial Sequence
  derived and/or modified sequence opt2 from VP1__Norovirus_and/or_Norovirus-like__AF414415
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggccguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcucuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaccccccgccucuucaaccaccgcuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccgaccgcuucacccccaagcucggcucccucgagaucaucaccgaguccggcgacuucgacaccaaccaguccaccaaguucacccccgucggcaucggcgucgacaacgaggccgaguuccagcaguggucccuccccaacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15637 - RNA, 1647 nt, Artificial Sequence
  derived and/or modified sequence opt2 from VP1__Norovirus_and/or_Norovirus-like__KT779557
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaccgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaucaagcccuucacccuccccauccucaccaucuccgagauguccaacucccgcuuccccguccccaucgacucccuccacaccucccccaccgacaacaucgucguccagugccagaacggccgcgucacccucgacggcgagcucaugggcaccacccagcuccuccccucccagaucugcgccuuccgcggcguccucacccgcuccaccucccgcgccuccgaccaggccgacgccgccaccccccgccucuucaacuaccacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccggcgacuucgaccagaaccagcccauccgcuucacccccgucggcaucggcgucgacaacgaggccgacuuccagcaguggacccuccccgacuacuccggccaguucacccacaacaccaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuacaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 15638 - RNA, 1647 nt, Artificial Sequence
  derived and/or modified sequence opt2 from VP1__Norovirus_and/or_Norovirus-like__AY247432
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaacggcaacuucgucguccagugccagaacggccgcgucacccucgacggcgagcucaugggcaccacccagcuccuccccucccagaucugcgccuuccgcggcguccucacccgccaggucucccgcgccggcgaccagaucgacaccgccaccccccgcuccuucggcaaccacuggcacauccagcucgacaaccucaacggcacccccuacgaccccgccgaggacauccccggcccccucggcacccccgacuuccagggcaucgucuucggcgucgccucccagcgcaacuccgacggcaccacccgcgcccacgaggccaaggucgacacccgcaccggccgcuucacccccaagcucggcucccucgucaucuccaccgacuccgaggacuuccagcagaacaagcccacccgcuucacccccgucggcgucggcgucgacuccgaggaggaguucgaccaguggucccuccccgacuacuccggccccaucacccacaacaugaaccucgcccccgccgucgcccccaacuuccccggcgagcagcuccucuucuuccgcucccagcuccccuccuccggcggcaucuccaagggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaaggacggcgacucccccaucaccgucccccccaacggcuacuuccgcuucgaguccugggucaaccccuucuacacccucgcccccaugggcaccggcaacggccgccgccgcauccaguga

SEQ ID NO: 15639 - RNA, 1647 nt, Artificial Sequence
  derived and/or modified sequence opt2 from VP1__Norovirus_and/or_Norovirus-like__AF414411
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccucgagaucaaccccuaccucgcccaccucgcccgcauguacaacggcuacgccggcgucuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcucuucacccuccccauccucaccaucuccgagauguccaacucccgcuuccccguccccaucgacucccuccacaccucccccaccaagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaccccccgccucuucggccaccgcuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaucaccgaguccgacgacuucgacaccaaccaguccaccaaguucacccccgucggcaucggcgucgacaacgaggccgaguuccagcaguggucccuccccaacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15640 - RNA, 1647 nt, Artificial Sequence
  derived and/or modified sequence opt2 from VP1__Norovirus_and/or_Norovirus-like__AJ277617
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucgcccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgaggucuucaccgucuccugccgcguccucacccgccccucccccgacuucuccuucaacuuccucgucccccccaccgucgaguccaagaccaagcucuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaccccccgccucuucaaccaccgcuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggccgacaccaccuccggccgcuucacccccaagcucggcucccucgagaucaucaccgaguccgacgacuucgacaccaaccaguccaccaaguucacccccgucggcaucggcgucgacaacgaggccgaguuccagcaguggucccuccccaacuacuccggccaguucacccacaacaugaaccucgcccccgccgucgcccccaacuuccccggcgagcagcuccucuucuuccgcucccagcuccccuccuccggcggccgcuccaacggcguccucgacugccucaucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuaccuccgcuucgaguccugggucaaccccuucuacacccucgcccccaugggcaccggcaacggccgccgccgcauccaguga

SEQ ID NO: 15641 - RNA, 1647 nt, Artificial Sequence
  derived and/or modified sequence opt2 from VP1__Norovirus_and/or_Norovirus-like__LC036561
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgaguucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcguccaguga

SEQ ID NO: 15642 - RNA, 1647 nt, Artificial Sequence
  derived and/or modified sequence opt2 from VP1__Norovirus_and/or_Norovirus-like__KT732274
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgaguucuccuucaacuuccucgucccccccaccgucgaguccaagaccaagcucuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccggcgacuucgaccagaaccagcccacccgcuucacccccgucggcaucggcgucgacuccgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcguccaguga

SEQ ID NO: 15643 - RNA, 1647 nt, Artificial Sequence
  derived and/or modified sequence opt2 from VP1__Norovirus_and/or_Norovirus-like__AY247439
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaacaacaacuucgucguccagugccagaacggccgcgucacccucgacggcgagcucaugggcaccacccagcuccuccccucccagaucugcgccuuccgcggcguccucgcccgccagaucaaccgcgccggcgaccagaucgacaccaccaccccccgcuccuucgaccaccacuggcacauccagcucgacaaccucaacggcacccccuacgaccccgccgaggacauccccggcccccucggcacccccggcuucaagggcaucgucuucggcgucgccucccagcgcaacuccgacggcaccacccgcgcccacgaggccaaggucgacacccgcaccggccgcuucacccccaagcucggcucccucgucaucuccaccgacuccgaggacucccagcagaacaagcccacccgcuucacccccgucggcgucggcgucgacaacgaggaggaguucgaccaguggucccuccccaacuacuccggccccaucacccacaacaugaaccucgcccccgccgucgcccccaacuuccccggcgagcagcuccucuucuuccgcucccagcuccccuccuccggcggcaccuccaagggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaaggacggcgacucccccaucaccgucccccccaacggcuacuuccgcuucgaguccugggucaaccccuucuacacccucgcccccaugggcaccggcaacggccgccgccgcauccaguga

SEQ ID NO: 15644 - RNA, 1647 nt, Artificial Sequence
  derived and/or modified sequence opt2 from VP1__Norovirus_and/or_Norovirus-like__AF539439
augaagauggccuccuccgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagcuccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacacccccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15645 - RNA, 1647 nt, Artificial Sequence
  derived and/or modified sequence opt2 from VP1__Norovirus_and/or_Norovirus-like__AF414413
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacggcgucuucaccgucuccugccgcguccucacccgccccucccccgacuucuccuucaacuuccucgucccccccaccgucgaguccaagacccgccucuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacacccccaucccccgccucuucaaccaccgcuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacgccacccccggccgcuucacccccaagcucggcucccucgagaucaucaccgaguccgacgacuucgacaccaaccaguccaccaaguucacccccgucggcaucggcgucgacaacgaggccgaguuccagcaguggucccuccccaacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15646 - RNA, 1647 nt, Artificial Sequence
  derived and/or modified sequence opt2 from VP1__Norovirus_and/or_Norovirus-like__AF427112
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacacccgccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccugcgaccccgccgaggacauccccggcccccucggcacccccgacuuccgcggcaaggucuucggcgucgccucccagcgcaaccccgacuccaccaccggcgcccacgaggccaaggucgacaccaccgccggccgcuucacccccaagcucggcucccucgagaucuccaccgaguccggcgacuucgaccagaaccagcccaccaaguucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15647 - RNA, 1647 nt, Artificial Sequence
  derived and/or modified sequence opt2 from VP1__Norovirus_and/or_Norovirus-like__AF190817
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacccccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgagucccuccacaccggccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacguccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgacuccuccgacuucgaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggagugggcccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15648 - RNA, 1647 nt, Artificial Sequence
  derived and/or modified sequence opt2 from VP1__Norovirus_and/or_Norovirus-like__LC035072
augaagauggccuccaacgacgccacccccuccaacgacggcgccgccggccucguccccgagaucaacaacgaggccauggcccucgaccccgucgccggcgccgccaucgccgccccccucaccggccagcagaacgucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgaguucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccccaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccgacgacuucgaccagaaccagcccacccgcuucacccccgucggcaucggcgucgaccgcgaggccgacuuccagcaguggucccuccccgacuacuccggccaguucacccacaacaugaaccucgcccccgccgucgccgccaacucccccggcgagcagcucaucuucuucuggucccagucccccuacugcggcggccgcuccaaccgcguccucgacugcauggucccccaggaguggguccagcacuucuaccaggaguccgcccccgcccagacccagcucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcguccaguga

SEQ ID NO: 15649 - RNA, 1647 nt, Artificial Sequence
  derived and/or modified sequence opt2 from VP1__Norovirus_and/or_Norovirus-like__DQ093064
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacgccgaccccaacgaguccaucgucguccagccccagaacggccgcugcacccucgacggcacccuccagggcaccacccagcucguccccacccagaucugcgccuuccgcggcacccucaucucccagaccgcccgcgccaccgacuccaccgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggcccccaggagcagggccacuacgccacccgcgcccacgaggcccacaucgacaccaccgaccccaaguacgcccccaagcucggcaccauccucaucaaguccgaguccaacgacuucaucaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuacggcuccggcuacaucgacugccucaucccccaggaguggggccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcuga

SEQ ID NO: 15650 - RNA, 1647 nt, Artificial Sequence
  derived and/or modified sequence opt2 from VP1__Norovirus_and/or_Norovirus-like__L23830
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccgccaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucguccccuccaccauggaguccaagaccaagcccuucacccuccccauccucaccaucuccgagauguccaacucccgcuuccccguccccaucgacucccuccacaccucccccaccgaguccaucgucguccagugccagaacggccgcgucacccucgacggcgagcucaugggcaccacccagcuccuccccaaccagaucugcgccuuccgcggcacccucacccgcuccaccaaccgcgccuccgaccaggccgacaccgccaccccccgccucuucaaccaccacuggcacauccagcucgacaaccucaacggcacccccuacgaccccgccgaggacauccccgccccccucggcacccccgacuuccgcggcaaggucuucggcgucgccggccagcgcaaccccgacuccaccacccgcgcccacgaggccaaggucgacaccaccuccggccgcuucacccccaagcucggcucccucgagaucaccaccgaguccgacgacuucgaccccaaccaguccaccaaguucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 15651 - RNA, 1647 nt, Artificial Sequence
  derived and/or modified sequence opt2 from VP1__Norovirus_and/or_Norovirus-like__KX907728
augaagauggccuccaacgacgccccccccuccuccgacggcgccggcaaccucguccccgagucccaccaggagguccucccccucgcccccgucgccggcgccgagcucgccgcccccgucgucggccagaccaacaucaucgaccccuggaucaaggagaacuucguccaggccccccagggcgaguucaccgucucccccaagaacgcccccggcgagauccucgucaaccucgagcucggccccaaccucaaccccuaccucgagcaccucucccgcauguacaacgccuacgccggcggcaucgaggucgagaucauccucgccggcaacgccuucaccgccggcaagauccucaucgccgccgucccccccaacuuccccgucgaguccgucuccgccucccaggccacccaguucccccacgccaucgucgacguccgcacccucgagcccguccgccucccccuccccgacguccgcuccaacuucuuccacuacaccaccaaggacgagcccaagaugcgccucgucaucuggcucuacaccccccuccgcaccaacggcuccggcgacgacuccuucaccgucuccggccgccuccucacccgccccuccauggacuuccaguucuccuuccucgucccccccaccgucgagaccaagaccguccucuucaccguccccggccucaccccccaggagauguccaacucccgcuggcccgcccagaucuccggcauggucguccgcggcaacgagccccaggucguccaguuccagaacggccgcugccacaccgacggcacccuccucggcaccaccaccgucuccgagcagugcaucgccggcuucgucggcaccuccaccaacacccgcuccgccaccggcuccaccaccgagacccgcaccggcgacaccgaccucuggcuccgccucgaggagcccaacggccagcccuacgacaucuucggcgaccagcccgccccccucggcacccccgacuuccgcgccgucaucgucggcuucgccucccgcccccagacccagggcuccuacaugaacgaggccuacgucaacaccgucgacucccacuucgcccccgccaccggcaacaccaagaucauccuccgccgcggcggcaccggccacgucggcggcggccaccucuggaaguuccgccccuucggcgucgagggcggcgagggccgcgucuccuaccaggaguacguccuccccaacuacuccggcgccaccgccuccaaccacaaccucgccccccccgucgccccccgcaugcccggcgagcuccuccuccucuucgaguccgacaugcccgucugggacgacggccacggcgccgcccccgcccagaagauccacugccuccucccccagcaguucaucacccacuucuucgacucccaggcccccgcccucgccgaggccgcccuccuccgcuacguccaccccgacuccucccgcguccucuucgagaccaagcucuaccgcgagggcuucauggucgucuccgcccccaccggccgcuucgacuucccccucgacggcuacuuccgcuucgacuccugggucaacuccuucuacguccucucccccgucggcuccggccagggccgccgcuga

SEQ ID NO: 15652 - RNA, 1644 nt, Artificial Sequence
  derived and/or modified sequence opt2 from VP1__Norovirus_and/or_Norovirus-like__AB039779
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccccccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcuccuccgucggcgccacccgcgcccacgagguccacaucgacaccaccaacccccgcuacacccccaagcucggcuccguccucauguacuccgaguccuccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacgcccucacccccaugggcaccggccagggccgccgccgcguccaguga

SEQ ID NO: 15653 - RNA, 1644 nt, Artificial Sequence
  derived and/or modified sequence opt2 from VP1__Norovirus_and/or_Norovirus-like__AB039778
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcuccuccgucggcgccacccgcgcccacgagguccacaucgacaccaccaacccccgcuacacccccaagcucggcuccguccucauguacuccgaguccuccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15654 - RNA, 1644 nt, Artificial Sequence
  derived and/or modified sequence opt2 from VP1__Norovirus_and/or_Norovirus-like__KY424345
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcgccgucuucggcgucgccucccagcgcgacgucuccggcacccaggucggcgccacccgcgcccacgagguccacaucaacaccaccgacccccgcuacacccccaagcucggcuccauccucaugcacuccgaguccgacgacuucgucaccggccagcccauccaguucacccccgucggcaugggcgacaacgacuggcaccagugggagcuccccgacuacuccggccaccucacccucaacaugaaccucgcccccgccgucgcccccgccuuccccggcgagcgcauccucuucuuccgcuccaucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 15655 - RNA, 1644 nt, Artificial Sequence
  derived and/or modified sequence opt2 from VP1__Norovirus_and/or_Norovirus-like__HQ169542
augaugauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucgucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcggcuccgucggcgccacccgcgcccacgagguccacaucgacaccaccaacccccgcuacacccccaagcucggcuccguccucauguacuccgaguccuccgacuucgacgacggccagcccacccgcuucacccccaucggcaugggcgccgacgacuggcgccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15656 - RNA, 1644 nt, Artificial Sequence
  derived and/or modified sequence opt2 from VP1__Norovirus_and/or_Norovirus-like__KX228762
augaagauggccuccaacgacgccgcccccuccaacgacggcgccgccaaccucguccccgaggccaccaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccaucggcgccacccgcgcccacgagguccacaucgacaccaccaacccccgcuacacccccaagcucggcuccguccucaugcacuccgaguccaacgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15657 - RNA, 1644 nt, Artificial Sequence
  derived and/or modified sequence opt2 from VP1__Norovirus_and/or_Norovirus-like__AF414410
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagauccuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccgucuuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcgcccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcuccuccgucggcgccacccgcgcccacgagguccacaucgacaccaccgacccccgcuacacccccaagcucggcuccguccucauguacuccgaguccaacgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15658 - RNA, 1644 nt, Artificial Sequence
  derived and/or modified sequence opt2 from VP1__Norovirus_and/or_Norovirus-like__KU935739
augaagauggccuccaacgacgccgcccccuccaacgacggcgccgccaaccucguccccgaggccaccaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcgcccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccaucggcgccacccgcgcccacgagguccacaucgacaccaccaacccccgcuacacccccaagcucggcuccguccucauguacuccgaguccaacgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15659 - RNA, 1644 nt, Artificial Sequence
  derived and/or modified sequence opt2 from VP1__Norovirus_and/or_Norovirus-like__KX268709
augaagauggccuccaacgacgccgcccccuccaacgacggcgccgccaaccucguccccgaggccaccaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcgcccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccaucggcgccacccgcgcccacgagguccacaucgacaccaccaacccccgcuacacccccaagcucggcuccguccucaugcacuccgaguccaccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 15660 - RNA, 1644 nt, Artificial Sequence
  derived and/or modified sequence opt2 from VP1__Norovirus_and/or_Norovirus-like__KX158282
augaagauggccuccaacgacgccgcccccuccaacgacggcgccgccaaccucguccccgaggccaccaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccguccucggcgucgccucccagcgcaacaccaccggcuccuccaucggcgccacccgcgcccacgagguccacaucgacaccaccaacccccgcuacacccccaagcucggcuccguccucaugcacuccgaguccaccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaucggccagggccgccgccgcguccaguga

SEQ ID NO: 15661 - RNA, 1644 nt, Artificial Sequence
  derived and/or modified sequence opt2 from VP1__Norovirus_and/or_Norovirus-like__AB126320
augaagauggccuccuccgacgccgcccccuccaccgacggcuccgcccgccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggagguccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccucccucacccucgacgagcucuccaacucccgcuuccccgcccccaucguccagcucuacaccaacccccacgacaaccucgucguccagccccagaacggccgcugcaccaucgacggccuccuccagggcaccacccagcucgucuccugcaacgucugcuccuuccgcggcaccaucggcgacggccagcccgccucccacuccgaggaggagaucaugcccauggccuucaacauccagcgcgagaucaugcucgagaaccucgacggcacccccuacgaccccgccgacgacauccccgccguccucggcucccccgacuuccagggcgucaucuucggcauccucucccagcgcaacaccgacggccagacccgcgcccacgaggccaaggucgacacccgcgccgcccgcuucgcccccaagcucggcuucgucgucgccaccgucgaguccaccgacuuccacgccaaccagcccucccgcuucacccccgucggccucggcggcgacaacaaccaggacuucaaccaguggcgccuccccgccuacggcggcgcccucaccaacaacaccaaccucgccccccccgucaugcccgucuaccccggcgagcagcuccucuucuuccgcucccagcuccccuccuccggcggcgucgucggcggcuggcucgacugccuccucccccaggaguggguccagcacuucuuccaggaguccgccaccucccaguccgacgucgcccucguccgcuacaucaaccccaccaccggccgcguccucuucgaggccaagcuccacaagcagggcuuccucaccgucgccgccuccggcuccuacccccucgucguccccgccgacggcuacuuccgcuucgaguccugggucaaccaguucuacacccucgcccccaugggcaacggcuccggccgccgccgcgcccgcuga

SEQ ID NO: 15662 - RNA, 1644 nt, Artificial Sequence
  derived and/or modified sequence opt2 from VP1__Norovirus_and/or_Norovirus-like__AY077644
augaagauggccuccaacgacgccucccccuccgccgacggcuccgccggccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggagguccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccucccucacccucgacgagcucuccaacucccgcuuccccgcccccaucguccagcucuacaccaacccccacgacaaccucgucguccagccccagaacggccgcugcaccaucgacggccuccuccagggcaccacccagcucgucuccugcaacgucugcuccuuccgcggcacccucggcgacggccagcccgccucccacuccgaggaggagaucaugcccauggccuucaacauccagcgcgagaucaugcucgagaaccucgacggcucccccuacgaccccaccgacgacauccccgccguccucggcucccccgacuuccagggcgucgucuucggcauccucucccagcgcaacaccgacggccagacccgcgcccacgaggccaaggucgacacccgccucgcccgcuucgcccccaagcucggcuucgucgucgccaccgucgagaacaccgacuuccacgccaaccagcccugccgcuucacccccgucggccucggcggcgacaacaaccgcgacuucaaccaguggggccuccccgccuacggcggcgcccucaccaacaacaccaaccucgccccccccgucaugcccgucuaccccggcgagcagcuccucuucuuccgcucccagcuccccuccuccggcggcgucgucggcggcuggcucgacugccuccucccccaggaguggguccagcacuucuuccaggaguccgccaccucccaguccgacgucgcccucguccgcuacaucaaccccaccaccggccgcguccucuucgaggccaagcuccacaagcagggcuuccucaccgucgccgccuccggcuccuacccccucgucguccccgccgacggcuacuuccgcuucgaguccugggucaaccaguucuacacccucgcccccaugggcaacggcuccggccgccgccgcguccgcuga

SEQ ID NO: 15663 - RNA, 1644 nt, Artificial Sequence
  derived and/or modified sequence opt2 from VP1__Norovirus_and/or_Norovirus-like__AY823306
augaagauggccuccuccgacgccgcccccuccuccgacggcuccgccggccucguccccgaggucaacuccgagaccauggcccucgagcccgucgucggcgccccccucgccgcccccgucgccggccagcacaacaucaucgaccccuggaucaagcucaacuucguccaggcccccaacggcgaguucaccgucuccccccgcaacgcccccggcgagauccuccucgaccucgagcucggccccgaccucaaccccuaccucgcccaccucucccgcauguacaacgccuacgccggcggcauggagguccaggucauccucgccggcaacgccuucaccgccggcaagaucaucuucgccgccgucccccccaacuucccccucgagaaccucuccgccgcccagaucaccaugugcccccacaucaucgucgacguccgccagcucgagcccgucaugcuccccaugcccgacguccgcaaccgccucuuccacuacaaccagguccgcgagccccgccuccgccucgucgccuaccucuacaccccccuccgcgccaacaacgccggcgacgacgucuucaccgucuccugccgcguccucacccgccccucccaggacuucgaguucauguuccucgucccccccuccgucgaguccaagaccaagcccuucucccuccccaaccucacccucgccgagcucuccaacucccgcuucccccuccccaucgagcagcucuacaccaacccccucgacaaccucgucguccagccccagaacggccgcugcaccaucgacggcauccuccucggcaccacccagcucguccccucccucaucugcuccaugcgcggcacccucgaggccgaccaggccuccggccacaccgacgacgaguccguccagucccgcgccuucaaccgccagcgcucccucaugcucgagaaccccgacggcuccgccuucgaccccuccgacgagguccccgccguccucggcguccccgacuuccgcggcgucgucuucggcguccucucccagcgcaacaacggcgacaccacccgcucccacgaggccaagaucgacacccgccgcccccgcuacgcccccaagcucggcuucgucgagguccucaccgaguccgacgacuuccagaacggcccccccaccaaguucacccccgucggccucggcggcgacggcaaccccgacuuccagcagugggcccuccccgacuacggcggcgcccucaccaacaacaccaaccucgccccccccgucguccccgucuaccccggcgagcagauccucuucuuccgcucccagcuccccuccuccggcggcaccgucgccggcuggcucgacugccuccucccccaggaguggauccagcacuucuaccaggacuccgccgccgcccaguccgacgucgcccucguccgcuacaucaaccccgccaccggccgcguccucuucgaggccaagcuccaccgccagggcuuccucaccgucuccgccgccggcccccaccccgucgucgcccccgccgacggcuacuuccgcuucgaguccugggucaaccaguucuacacccucgcccccaugggcaacggcuccggccgccgccgcgucuga

SEQ ID NO: 15664 - RNA, 1638 nt, Artificial Sequence
  derived and/or modified sequence opt2 from VP1__Norovirus_and/or_Norovirus-like__KF586508
augaugauggccuccaaggacgccaccuccaacauggacggcaccuccggcgccggccagcucguccccgagaacaacaacaccuccgagcccaucaacauggagcccgucgccggcgccgucaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucgcccaccucucccagauguacaacggcugggucggcaacaugaagguccgcgucguccucgccggcaacgccuucuccgccggcaagaucaucgucugcugcaucccccccggcuucuccgcccccaacaucuccaucgcccaggccaccauguucccccacgucaucgccgacguccgcguccucgagcccaucgacaucccccucgacgacguccgcaacguccucuuccacaacaacgacaacggcaaccagaccaugcgccuccucugcaugcucuacaccccccuccgcuccggcggcaccuccuccggcaccgaccccuucgucaucgccggccgcguccucaccugccccacccccgacuucaacuuccucuuccucgucccccccaccgucgagcagaagaccaagcaguucuccguccccaaccucccccucaacgucauguccaacucccgcguccccucccuccucaacgccauggucgucucccccgaccaggcccaggucguccaguuccagaacggccgcugcacccucgacggccagaugcucggcaccaccaccgucuccgccuccugcgucgcccgcuuccgcggcaagaccuuccaggcccccgacaaccgccucggcaucaaccucgccgagaucuccggcgagcccuaccacgccuucgagucccccgccccccucggcuuccccgacuucggcgacggcgacuggcacgucaccgccaccaaggucacccccucccagcucgaggccaacgaccccgucgucaugggcaacguccagcccuacaacccccaguucgccccccaccucggcacccucgucgucgagaaccccacccccgacaacgucaccaccggcaccgaccuccucuucaacaucaccuggcucuccaaccgcgccaacaaccgcuucaaccccugggucauccccaacuacggcuccacccucaccgaggccgcccagcucgcccccuccaucuucccccccggcuucggcgagaccaucgucuacuucaacuccaccuuccccgccgucggcgccaccacccacgccgccauccccugccuccucccccaggaguucgucgcccacuucgucaacgagcaggcccccauccgcggcgaggccgcccuccuccacuacaucgaccccgacacccaccgcaaccucggcgaguucaagaucuaccccgagggcuucgucaccugcguccccaacgucggcggcaccggcccccagucccuccccaccaacggcaucuucgucuucgucuccugggucucccgcuacuaccagcucaagcccgucggcaccgccggccaggcccgccgccucuga

SEQ ID NO: 15665 - RNA, 1638 nt, Artificial Sequence
  derived and/or modified sequence opt2 from VP1__Norovirus_and/or_Norovirus-like__HQ637267
augaugauggccuccaaggacgccaccuccaacauggacggcaccuccggcgccggccagcucguccccgagaacaacaacaccuccgagcccaucaacauggagcccgucgccggcgccgucaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucgcccaccucucccagauguacaacggcugggucggcaacaugaagguccgcgucguccucgccggcaacgccuucuccgccggcaagaucaucgucugcugcaucccccccggcuucuccgcccccaacaucuccaucgcccaggccaccauguucccccacgucaucgccgacguccgcguccucgagcccaucgacaucccccucgacgacguccgcaacguccucuuccacaccaacgacaacggcaaccagaccaugcgccuccucugcaugcucuacaccccccuccgcuccggcggcaccuccuccggcaccgaccccuucgucaucgccggccgcguccucaccugccccacccccgacuucaacuuccucuuccucgucccccccaccgucgagcagaagaccaagcaguucuccguccccaaccucccccucaacgucauguccaacucccgcguccccucccuccucaacgccauggucgucucccccgaccaggcccaggucguccaguuccagaacggccgcugcacccucgacggccagaugcucggcaccaccaccgucuccgccuccugcgucgcccgcuuccgcggcaagaccuuccaggcccccgacaaccgccucggcaucaaccucgccgagaucuccggcgagcccuaccacgccuucgagucccccgccccccucggcuuccccgacuucggcgacggcgacuggcacgucaccgccaccaaggucacccccucccagcucgaggccaacgaccccgucgucgucggcaacguccagcccuacaacccccaguucgccccccaccucggcacccucgucgucgagaaccccacccccgaccaggucgccaccggcaccgaccuccucuucaacaucaccuggcucuccaaccgcgccaacaaccgcuucaaccccugggucauccccaacuacggcuccacccucaccgaggccgcccagcucgcccccuccaucuucccccccggcuucggcgagaccaucgucuacuucaacuccaccuuccccgccgucggcgccaccacccacgccgccauccccugccuccucccccaggaguucgucgcccacuucgucaacgagcaggcccccauccgcggcgaggccgcccuccuccacuacaucgaccccgacacccaccgcaaccucggcgaguucaagaucuaccccgagggcuucgucaccugcguccccaacgucggcggcaccggcccccagucccuccccaccaacggcgucuucgucuucgucuccugggucucccgcuacuaccagcucaagcccgucggcaccgccggccaggcccgccgccucuga

SEQ ID NO: 15666 - RNA, 1629 nt, Artificial Sequence
  derived and/or modified sequence opt2 from VP1__Norovirus_and/or_Norovirus-like__AY134748
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccaggacaacgaccaccucuacaacaucaccaucaccaaccucaacggcucccccuucgaccccuccgaggacauccccgccccccucggcguccccgacuuccagggccgcgucuucggcgucaucacccagcgcgacaagcagaacgccgccggccagucccagcccgccaaccgcggccacgacgccgucguccccaccuacaccgcccaguacacccccaagcucggccagguccagaucggcaccuggcagaccgacgaccucaaggucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuaccucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15667 - RNA, 1629 nt, Artificial Sequence
  derived and/or modified sequence opt2 from VP1__Norovirus_and/or_Norovirus-like__AY054300
augaagauggccuccaacgacgccgcccccuccaccgacggcgccgccggccucguccccgaguccaacuccgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccguccccaucgaccagauguucaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcagaacgccgccggccacuccgagcccgccaaccgcggccacgacgccgucguccccaccuacaccgcccaguacacccccaagcucggccagauccagaucggcaccuggcagaccgacgaccuccaggucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuaccucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15668 - RNA, 1629 nt, Artificial Sequence
  derived and/or modified sequence opt2 from VP1__Norovirus_and/or_Norovirus-like__KY485125
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgagaucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15669 - RNA, 1629 nt, Artificial Sequence
  derived and/or modified sequence opt2 from VP1__Norovirus_and/or_Norovirus-like__KY485123
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggccacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15670 - RNA, 1629 nt, Artificial Sequence
  derived and/or modified sequence opt2 from VP1__Norovirus_and/or_Norovirus-like__KY485126
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgagaucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaucaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15671 - RNA, 1629 nt, Artificial Sequence
  derived and/or modified sequence opt2 from VP1__Norovirus_and/or_Norovirus-like__U70059
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuccaagggcgaggucaccgcccaccuccaggacaacgaccaccucuacaacaucaccaucaccaaccucaacggcucccccuucgaccccuccgaggacauccccgccccccucggcguccccgacuuccagggccgcgucuucggcgucaucacccagcgcgacaagcagaacgccgccggccagucccagcccgccaaccgcggccacgacgccgucguccccaccuacaccgcccaguacacccccaagcucggccagguccagaucggcaccuggcagaccgacgaccucaaggucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuaccucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15672 - RNA, 1629 nt, Artificial Sequence
  derived and/or modified sequence opt2 from VP1__Norovirus_and/or_Norovirus-like__LC145808
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacgcccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15673 - RNA, 1629 nt, Artificial Sequence
  derived and/or modified sequence opt2 from VP1__Norovirus_and/or_Norovirus-like__LC145795
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccaucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15674 - RNA, 1629 nt, Artificial Sequence
  derived and/or modified sequence opt2 from VP1__Norovirus_and/or_Norovirus-like__AB629941
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgccucuacaacggcuacgccggcggcauggagguccaggucaugcucgccggcaacgccuucaccgccggcaagcucgucuuccccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaucgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15675 - RNA, 1629 nt, Artificial Sequence
  derived and/or modified sequence opt2 from VP1__Norovirus_and/or_Norovirus-like__LC145792
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccaguggguccucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15676 - RNA, 1629 nt, Artificial Sequence
  derived and/or modified sequence opt2 from VP1__Norovirus_and/or_Norovirus-like__LC145786
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacucccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15677 - RNA, 1629 nt, Artificial Sequence
  derived and/or modified sequence opt2 from VP1__Norovirus_and/or_Norovirus-like__LC145793
augaagauggccuccaacgacgccgcccccuccaccgacggcgccgccggccucguccccgaguccaacaacgaggucauggcccucgagcccgucgccggcgucgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucgagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15678 - RNA, 1629 nt, Artificial Sequence
  derived and/or modified sequence opt2 from VP1__Norovirus_and/or_Norovirus-like__LC145791
augaagauggccuccaacgacgucgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15679 - RNA, 1629 nt, Artificial Sequence
  derived and/or modified sequence opt2 from VP1__Norovirus_and/or_Norovirus-like__LC145788
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucgccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15680 - RNA, 1629 nt, Artificial Sequence
  derived and/or modified sequence opt2 from VP1__Norovirus_and/or_Norovirus-like__LC145803
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcuccuccuucgaccccuccgaggacauccccgccccccucggcauccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15681 - RNA, 1629 nt, Artificial Sequence
  derived and/or modified sequence opt2 from VP1__Norovirus_and/or_Norovirus-like__LC145804
augaagauggccuccaacgacgccgcccccuccaccgacggcgccgccggccucguccccgaguccaacuccgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucgccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15682 - RNA, 1629 nt, Artificial Sequence
  derived and/or modified sequence opt2 from VP1__Norovirus_and/or_Norovirus-like__LC145801
augaagauggccuccaacgacgccgcccccuccaccgacggcgccgccggccucguccccgaguccaccaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcgcccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15683 - RNA, 1629 nt, Artificial Sequence
  derived and/or modified sequence opt2 from VP1__Norovirus_and/or_Norovirus-like__LC145802
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggccacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgaguucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggccuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacgcccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucgaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15684 - RNA, 1629 nt, Artificial Sequence
  derived and/or modified sequence opt2 from VP1__Norovirus_and/or_Norovirus-like__LC145805
augaagauggccuccaacgacgccgcccccuccaccgacggcgccgccggccucguccccgaguccaacuccgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucgccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgucggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15685 - RNA, 1629 nt, Artificial Sequence
  derived and/or modified sequence opt2 from VP1__Norovirus_and/or_Norovirus-like__LC145797
augaagauggccuccaacgacgccgcccccuccaccgacggcgccgccggccucguccccgaguccaacaacgaggucauggcccucgagcccgucgccggcgucgcccucgccgcccccgucaccggccagaccaacaucaucgaccccuggauccgcgccaacuucguccccgcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcucuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacaucuccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15686 - RNA, 1629 nt, Artificial Sequence
  derived and/or modified sequence opt2 from VP1__Norovirus_and/or_Norovirus-like__LC145806
augaagauggccuccaacgacgccgcccccuccaccgacggcgccgccggccucguccccgaguccaacuccgaggucauggcccucgagcccgucgccggcgccgcccucgccgcccccgucaccggccagaccaacaucaucgaccccuggauccgcgccaucuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucgccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 15687 - RNA, 1629 nt, Artificial Sequence
  derived and/or modified sequence opt2 from VP1__Norovirus_and/or_Norovirus-like__KU306738
augaagauggccuccaacgacgccgcccccuccaacgacggcgccuccucccucguccccgagaucaacaacgagaccauggcccucgagcccgucgccggcggcgccaucgccgccccccucaccggccagaccaacuucaucgaccccuggauccgcaacaacuacguccaggcccccaacggcgaguucaccaucuccccccgcaacucccccggcgagauccuccucaaccucgagcucggccccgagcucaaccccuuccucgcccaccucgcccgcauguacaacggcuacgccggcggcgucgacguccaggucaucauggccggcaacgccuucaccgccggcaaggucaucuucgccgccguccccccccacuuccccgucgagucccucucccccccccagaucaccauguucccccacaucaucgucgacguccgcacccucgagcccaucaacauccccauccccgacguccgcaacaacuucuuccacuacaaccagaacaacgagccccgcaugcgccucgucgccaugcucuacaccccccuccgcuccaacggcuccgccgacgacgucuucaccgucuccugccgcguccucaccaagcccuccgccgacuucgaguucaacuaccucgucccccccaccgucgagucccgcaccaagcccuucaccauccccauccucaccaucggcgagaugaccaacucccgcuuccccgucgccaucgacaugcucuacaccucccccaccgagaaccucgucguccagccccagaacggccgcugcacccucgagggcgagcuccucggcaccacccagcucgucacccccaacaucugcucccuccgcggcgccaucaccggccacgagggcaacgacgacaaccacaaguggcacaugaccgucaccaaccccaacggcuccgccuucgaccccaccgaggacguccccgccccccucggcacccccgacuucaucggcgacgucuacggcguccucucccagcgcaaccgcaacaucgaguccggccagaccgcccccgccaaccgcucccacgaggccgucaucuccacccgcuccaacaaguucacccccaagcucggcuccgucaugaucgccaccuggaacaccaacgacgucgagaaccagcccaccaaguucacccccgucggccucgagaaccccggcuccuuccaccagugggagcuccccaacuacuccggcgcccucacccucaacaugggccucgccccccccgucuuccccaccuaccccggcgagcagcuccucuucuuccgcuccuacaucccccucaagggcggcuucggcaacuccaucaucgacugccucgucccccaggaguggauccagcacuucuaccaggaguccgcccccucccagaccgacgucgcccucauccgcuacgucaaccccgagaccggccgcguccucuucgaggccaagcuccaccgccagggcuucaucaccgucgccaagaccggcgacucccccaucaacguccccgccaacggcuacuuccgcuucgacuccugggucaacuccuucuacucccucgcccccaugggcaccggcaacggccgccgccgcauccaguga

SEQ ID NO: 15688 - RNA, 1629 nt, Artificial Sequence
  derived and/or modified sequence opt2 from VP1__Norovirus_and/or_Norovirus-like__KM036380
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggccgcuucacccccaagaucggcaccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcaacuacccccucgucgucccccccaacggccacuuccgcuucgacuccugggucaaccaguucuacucccucgcccccaugggcaccggcaacggccgccgccgcguccaguga

SEQ ID NO: 15689 - RNA, 1629 nt, Artificial Sequence
  derived and/or modified sequence opt2 from VP1__Norovirus_and/or_Norovirus-like__AY113106
augaagauggccuccaacgacgccgcccccuccaacgacggcgccgccucccucguccccgagggcaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaccaacgucguccagugccagaacggccgcugcacccucgacggcgagcuccagggcaccacccagcuccucuccuccgccgucugcuccuaccgcggccgcaccgucgccaacaacggcgacaacugggaccagaaccuccuccagcucaccuaccccaacggcgccuccuacgaccccaccgacgagguccccgccccccucggcacccaggacuucuccggcaugcucuacggcguccucacccaggacaacgucaacgucuccaccggcgaggccaagaacgccaagggcaucuacaucuccaccaccuccggcaaguucacccccaaggucggcuccaucggccuccacuccaucaccgagcacguccaccccaaccagcagucccgcuucacccccgucggcgucgccgucaacgagaacacccccuuccagcaguggguccucccccacuacgccggcucccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcauccaguga

SEQ ID NO: 15690 - RNA, 1629 nt, Artificial Sequence
  derived and/or modified sequence opt2 from VP1__Norovirus_and/or_Norovirus-like__AB078334
augaagauggccuccaacgacgccgcccccuccaacgacggcgccgccucccucguccccgagggcaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccucgucgacaugaucucccccgcccagaucaccaugcucccccaccucaucgucgacguccgcacccucgagcccaucaugaccccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaccaacgucguccagugccagaacggccgcugcacccucgacggcgagcuccagggcaccacccagcuccucuccuccgccgucugcuuccuccagggccgcaccgucgccgacaacggcgacaacugggaccagaaccuccuccagcucaccuaccccaacggcgccuccuacgaccccaccgacgagguccccgccccccucggcacccaggacuucuccggcaugcucuacggcguccucacccaggacaacgucaacgucuccaccggcgaggccaagaacgccaagggcaucuacaucuccaccaccuccggcaaguucacccccaagaucggcuccaucggccuccacuccaucaccgagcacguccaccccaaccagcagucccgcuucacccccgucggcgucgccgucgacgagaacacccccuuccagcaguggguccucccccacuacgccggcucccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcauccaguga

SEQ ID NO: 15691 - RNA, 1629 nt, Artificial Sequence
  derived and/or modified sequence opt2 from VP1__Norovirus_and/or_Norovirus-like__KM289172
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaccgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgacaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccggcgacuucgaccagaaccagcccacccgcuucacccccgucggcaucggcgucgacuccgaggccgacuuccagcaguggacccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuacaugaccaucgccaaguccggcgacucccccaucaccgucccccccaacggcuacuuccgcuucgaguccugggucaaccccuucuacacccucgcccccaugggcaccggcaacuga

SEQ ID NO: 15692 - RNA, 1629 nt, Artificial Sequence
  derived and/or modified sequence opt2 from VP1__Norovirus_and/or_Norovirus-like__AY130762
augcgcauggccuccuccgacgcccccgucuccggcaccgacggcgccgccggccucguccccgagucccagcaggagguccucccccucgagcccgucgccggcguccagcucgccgcccccgucgccggccaguccaacaucaucgaccccuggauccgcaugaacuucguccaggcccccgccggcgaguucaccgucuccccccgcaacgcccccggcgagguccucaucgaccucgagcucggccccgagcucaaccccuaccucaaccaccucgcccgcauguacaacggcuacgucggcggcauggaggucgaggucguccucgccggcaacgccuucaccgccggcaagauccucuucgccgccgucccccccuccuuccccacccacggcaucuccgccgcccaggccaccaugcucccccacgucaucgucgacguccgccagcucgagcccguccgccucccccuccccgacguccgcaacgucauguuccacuucugccaggagaacaaggagccccgcaugcgcaucgucgccauccucuacaccccccuccgcgccaacggcgccggcgacgacgucuucaccgucuccugccgcguccucacccgccccucccccgacuucgacuucaucuuccucgucccccccuccgucgaguccaagcucaagcaguucacccuccccaaccuccagcccaacgagaugaccaacucccgcuuccccaccggcaucacccagcucuacaccucccccaacaccaaccucgucguccaguuccagaacggccgcugccuccucgacggcacccuccucggcaccacccccguccgcgccgccgacaucugcuccuuccgcggcgucaccuccaccgaggucgacgccaccgacuccccccgcgucgccggcucccaccgcaucaugguccagcucaaggagcccgacggcgaggaguucucccccaccggccccaaccccgcccccgucggcacccccgacuuccaggccgccaucuucggcacccucucccagcgcaacaccggcggcgccggccagaacuccaaccgcgcccacuucgccuacuucuacacccgcaaccccaccuucgcccccggcaucggcaccgucgucuucuccuucgacaccaccgacuuccagaaccgccagcccaccaaguucucccccuccggcgucuucgacgacaacuccuccgagcccuucaaccaguucucccuccccuacuacaacggcucccucggcgccgucgacgccggcaagcucgccccccccgucgcccccaacuaccccggcgagcagauccucuacuuccgcggcaacauccccuucaagggcggcuacggcgagggcgagaucgacucccuccucccccaggaguggaucacccacuucuacgccgagcaggcccccacccagggcgacgccgcccuccuccgcuacuacaaccccgacaccggccgcguccucuucgagugcaagcuccaccgcgagggcuucaucaccaucaacuacaccggcuccaacgcccucgccguccccgucaacggcgucuuccgcuucgagggcugggucaacaaguucuacacccucacccccauguga

SEQ ID NO: 15693 - RNA, 1629 nt, Artificial Sequence
  derived and/or modified sequence opt2 from VP1__Norovirus_and/or_Norovirus-like__KJ196290
augcgcauggccuccuccgacgcccccgucuccggcaccgacggcgccgccggccucguccccgagucccagcaggagguccucccccucgagcccgucgccggcguccagcucgccgcccccgucgccggccaguccaacaucaucgaccccuggauccgcaugaacuucguccaggcccccgccggcgaguucaccgucuccccccgcaacgcccccggcgagguccucaucgaccucgagcucggccccgagcucaaccccuaccucaaccaccucgcccgcauguacaacggcuacgucggcggcauggaggucgaggucguccucgccggcaacgccuucaccgccggcaagauccucuucgccgccgucccccccuccuuccccacccacggcaucuccgccgcccaggccaccaugcucccccacgucaucgucgacguccgccagcucgagcccguccgccucccccuccccgacguccgcaacgucauguuccacuucugccaggagaacaaggagccccgcaugcgcaucgucgccauccucuacaccccccuccgcgccaacggcgccggcgacgacgucuucaccgucuccugccgcguccucacccgccccucccccgacuucgacuucaucuuccucgucccccccuccgucgaguccaagcucaagcaguucacccuccccaaccuccagcccaacgagaugaccaacucccgcuuccccaccggcaucacccagcucuacaccucccccaacaccaaccucgucguccaguuccagaacggccgcugccuccucgacggcacccuccucggcaccacccccguccgcgccgccgacaucugcuccuuccgcggcgucaccuccaccgaggucgacgccaccgacuccccccgcgucgccggcucccaccgcaucaugguccagcuccgcgagcccgacggcgaggaguucucccccaccggccccaaccccgcccccgucggcacccccgacuuccaggccgccaucuucggcacccucucccagcgcaacaccggcggcgccggccagaacuccaaccgcgcccacuucgccuacuucuacacccgcaaccccaccuucgcccccggcaucggcaccgucgucuucuccuucgacaccaccgacuuccagaaccgccagcccaccaaguucucccccuccggcgucuucgacgacgacuccuccgagcccuucaaccaguucucccuccccuacuacaacggcucccucggcgccgucgacgccggcaagcucgccccccccgucgcccccaacuaccccggcgagcagauccucuacuuccgcggcuccguccccuucaagggcggcuacggcgagggcgagaucgacucccuccucccccaggaguggaucacccacuucuacgccgagcaggcccccacccagggcgacgccgcccuccuccgcuacuacaaccccgacaccggccgcguccucuucgagugcaagcuccaccgcgagggcuucaucaccaucaacuacaccggcuccaacgcccucgccguccccgucaacggcgucuuccgcuucgagggcugggucaacaaguucuacacccucacccccauguga

SEQ ID NO: 15694 - RNA, 1629 nt, Artificial Sequence
  derived and/or modified sequence opt2 from VP1__Norovirus_and/or_Norovirus-like__GQ856474
augcgcauggccuccuccgacgcccccgucuccggcaccgacggcgccgccggccucguccccgagucccagcaggagguccucccccucgagcccgucgccggcguccagcucgccgcccccgucgccggccaguccaacaucaucgaccccuggauccgcaugaacuucguccaggcccccgccggcgaguucaccgucuccccccgcgacgcccccggcgagguccucaucgaccucgagcucggccccgagcucaaccccuaccucaaccaccucgcccgcauguacaacggcuacgucggcggcauggaggucgaggucguccucgccggcaacgccuucaccgccggcaagauccucuucgccgccgucccccccuccuuccccacccacggcaucuccgccgcccaggccaccaugcucccccacgucaucgucgacguccgccagcucgagcccguccgccucccccuccccgacguccgcaacgucauguuccacuucugccaggagaacaaggagccccgcaugcgcaucgucgccauccucuacaccccccuccgcgccaacggcgccggcgacgacgucuucaccgucuccugccgcguccucacccgccccucccccgacuucgacuucaucuuccucguccuccccuccgucgaguccaagcucaagcaguucacccuccccaaccuccagcccaacgagaugaccaacucccgcuuccccaccggcaucauccagcucuacaccucccccaacaccaaccucgucguccaguuccagaacggccgcugccuccucgacggcacccuccucggcaccacccccguccgcgccgccgacaucugcuccuuccgcggcgucaccuccaccgaggucgacgccaccgacuccccccgcgucgccggcucccaccgcaucaugguccagcucaaggagcccgacggcgaggaguucucccccaccggccccaaccccgcccccgucggcacccccgacuuccaggccgccaucuucggcacccucucccagcgcaacaccggcggcgccggccagaacuccaaccgcgcccgcuucgccuacuucuacacccgcaaccccaccuucgcccccggcaucggcaccgucgucuucuccuucgacaccaccgacuuccagaaccgccagcccaccaaguucucccccuccggcgucuucgacgacgacuccuccgagcccuucaaccaguucucccuccccuacuacaacggcucccucggcgccgucgacgccggcaagcucgccccccccgucgcccccaacuaccccggcgagcagauccucuacuuccgcggcaacauccccuucaagggcggcuacggcgagggcgagaucgacucccuccucccccaggaguggaucacccacuucuacgccgagcaggcccccacccagggcgacgccgcccuccuccgcuacuacaaccccgacaccggccgcguccucuucgagugcaagcuccaccgcgagggcuucaucaccaucaacuacaccggcuccaacgcccucgccguccccgucaacggcgucuuccgcuucgagggcugggucaacaaguucuacacccucacccccauguga

SEQ ID NO: 15695 - RNA, 1629 nt, Artificial Sequence
  derived and/or modified sequence opt2 from VP1__Norovirus_and/or_Norovirus-like__LC145787
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacguccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacgucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15696 - RNA, 1629 nt, Artificial Sequence
  derived and/or modified sequence opt2 from VP1__Norovirus_and/or_Norovirus-like__AB629946
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuucaccgucuccaucgaccagauguacaccucccucaacgaggucaucuccguccagugccagaacggccgcugcacccucgacggcgagcuccgcggcaccacccagcuccaggucuccggcaucugcgccuucaagggcgaggucaccgcccacguccacgacaacgaccaccucuacaacgucaccaucaccaaccucaacggcucccccuucgaccccuccgaggacguccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacgucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15697 - RNA, 1629 nt, Artificial Sequence
  derived and/or modified sequence opt2 from VP1__Norovirus_and/or_Norovirus-like__KT962983
augaagauggccuccaacgacgccgcccccuccaccgacggcgccgccggccucguccccgaguccaacaccgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 15698 - RNA, 1626 nt, Artificial Sequence
  derived and/or modified sequence opt2 from VP1__Norovirus_and/or_Norovirus-like__AB083780
augaagauggccuccaacgacgccgcccccuccaacgacggcgccgccggccucguccccgagaucaacaccgaggucauggcccucgagcccgucgccggcggcgccaucgccgccccccucaccggccagaccaacaucaucgaccccuggauccgcaacaacuucguccaggcccccaacggcgaguucaccaucuccccccgcaacucccccggcgagauccuccucaacauggagcucggccccgagcucaaccccuuccucgcccaccucucccgcauguacaacggcuucgccggcggcauggagguccagguccucauggccggcaacgccuucaccgccggcaaggucaucuucgccgccguccccccccacuuccccgucgagaaccucucccccccccagaucaccauguucccccacaucaucaucgacguccgcacccucgagcccguccuccuccccaugcccgacguccgcaaccaguucuuccacuacaaccaggucaacgagccccgcaugcgccucgucgccaugcucuacaccccccuccgcuccaacggcuccaccgaggacgucuucaccgucuccugccgcguccucacccgccccucccccgacuucgaguucaacuaccucgucccccccaccgucgagucccgcaccaagcccuucacccuccccguccucaccaucggcgagaugaccaacucccgcuuccccgcccccaucgacaugcucuacaccucccccaacggcaacgucgucguccagccccagaacggccgcugcacccucgacggcgagcuccagggcuccacccagcucguccccgccaacgucugcgccuuccgcggcaagaucaccgcccgcaucgucgaccaggccgcccaccaguggcacaugcagaucgacaaccccaacggcacccucuucgaccccaccgaggacguccccgccccccucggcacccccgacuucaaggccaagaucuucggcgucaucucccagcgcaacgacuacaacgacggcucccagggccccgccaaccgcgcccacgacgccgucguccccaccaccuccgccaaguucacccccaagcucggcuccauccucgucggcaccugggagaacaacgacaucgagacccagcccuccaaguucacccccgucggccuccucgagaugaacgacuucaaccaguggucccuccccaacuacuccggcgcccucacccucaacaugggccucgcccccgccgucuuccccaccuuccccggcgagcagauccucuucuuccgcuccuucaucccccucaagggcggccacggcaaccccgccaucgacugccuccucccccaggaguggauccagcacuucuaccaggaguccgcccccucccagaccuccgucgcccucauccgcuacgucaaccccgacaccggccgcguccucuucgagggcaagcuccaccgccagggcuucaucaccaucgccaaguccggcgacggccccaucgucgucccccccaacggcuacuuccgcuucgacuccugggucaaccaguucuacucccucgcccccaugggcaacggcaacggccgccgccgcauccaguga

SEQ ID NO: 15699 - RNA, 1626 nt, Artificial Sequence
  derived and/or modified sequence opt2 from VP1__Norovirus_and/or_Norovirus-like__KX987840
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggccgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacgaguaccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagcccggcgacaagcucaaggucaccaccuucgagaugauccucggccccaccaccaacgucgaccaggcccccuaccagggccgcgucuacgccuccgucaccgccgccgccacccucaaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuaccccggcuccggcccccucaccuuccccaccgacggcuucuucgaggucgucuccugggucccccgccucuaccagcucgccuccgucggcucccucgccaccggccgcacccucaagcaguga

SEQ ID NO: 15700 - RNA, 1626 nt, Artificial Sequence
  derived and/or modified sequence opt2 from VP1__Norovirus_and/or_Norovirus-like__KR349276
augcgcauguccgacggcgccgcccccaaggccaacggcuccgaggccaacggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccucggcuccaacccccaguggcagaacggccgcguccacgucgacggcacccuccucggcaccacccccaucuccggcuccugggucucccucuucgccgccgaggccgccuacgaguuccaguccggcaccggcgaggucgccaccuucacccucaucgagcaggacggcuccgccuacguccccggcgagcgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggccgcgucuacgccucccucaccaccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccuggggcccccgccucuaccagcucgccuccgucggcucccucgccaccggccgcacccucaagcaguga

SEQ ID NO: 15701 - RNA, 1626 nt, Artificial Sequence
  derived and/or modified sequence opt2 from VP1__Norovirus_and/or_Norovirus-like__KM102449
augcgcauguccgacggcgccgcccccaaggccaacggcuccgaggccaucggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcgcccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccgucuaccgcauggucgaccuccccguccuccagccccgccucugcacccacgcccgcuggcccgcccccgucuacggccuccucgucgaccccucccuccccuccaacccccaguggcagaacggccgcguccacgucaacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuucuccggccagcucgagaucgagguccagaccgagaccaccaaguccggcgacaagcucaaggucaccaccuucgagaugauccucggccccaccaccaacgccgaccaggcccccuaccagggcaaggucuacgccucccucgccgccgccgccccccucgaccucgucgacggccgcguccgcgccgucccccgcuccgucuacuucuuccaggacguccuccccgaguacaacgacggccuccucgucccccucgcccccccccucggccccuuccuccccggcgagguccuccuccgcuuccgcaccuacguccgccagcucgacaccgccgacgccgccgcccagcccaucgacugcgcccucccccaggaguucaucuccugguucgccuccaacuccuucaccguccaguccgaggcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 15702 - RNA, 1626 nt, Artificial Sequence
  derived and/or modified sequence opt2 from VP1__Norovirus_and/or_Norovirus-like__KC792553
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaucggccaggucgccaccuucaccaugaucgagcaggacggcuccgccuacguccccggcgaccgcgccgccccccucggcuaccccgacuacuccggccagcucgagaucgagguccagaccgagaccaccaaggccggcgacaagcucaaggucaccaccuucgagaugauccucggccccaccaccaacgccgaccaggcccccuaccagggccgcgccuacgccucccucaccgccgccgccucccucgaccucgucgacggccgcguccgcgccgucccccgcuccaucuacuccuuccaggacguccuccccgaguacaacgacggccuccucgucccccucgcccccccccucggccccuuccuccccggcgagguccuccuccgcuuccgcaccuacaugcgccagcucgacaccgccgacgccgccgcccagcccaucgacugcgcccucccccaggaguucgucuccugguucgccuccaacuccuucaccguccaguccgacgcccuccucguccgcuaccgcaacacccucaccggccagcuccucuucgaggccaagcucuacuccgagggcuacaucgccgucuccuacuccggcuccggcccccucaccuuccccgccgacggcaucuucgaggucgucuccugggucccccgccucuuccagcucgccuccgucggcucccucgccaccggccgcacccucaagcaguga

SEQ ID NO: 15703 - RNA, 1626 nt, Artificial Sequence
  derived and/or modified sequence opt2 from VP1__Norovirus_and/or_Norovirus-like__AB809991
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcgucuga

SEQ ID NO: 15704 - RNA, 1626 nt, Artificial Sequence
  derived and/or modified sequence opt2 from VP1__Norovirus_and/or_Norovirus-like__AB809990
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcgucuga

SEQ ID NO: 15705 - RNA, 1626 nt, Artificial Sequence
  derived and/or modified sequence opt2 from VP1__Norovirus_and/or_Norovirus-like__AB809977
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagcgcaccggcgaggccaagaacgccaagggcaucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcgucuga

SEQ ID NO: 15706 - RNA, 1626 nt, Artificial Sequence
  derived and/or modified sequence opt2 from VP1__Norovirus_and/or_Norovirus-like__AB809987
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucauccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcgucuga

SEQ ID NO: 15707 - RNA, 1626 nt, Artificial Sequence
  derived and/or modified sequence opt2 from VP1__Norovirus_and/or_Norovirus-like__AJ844469
augaugauggccuccaaggacgcccccuccaacauggacggcaccuccggcgccggccagcucguccccgaggccaacaccgccgaccccaucccccucgagcccgucgucggcgccgccaccgccgccgccaccgccggccaggucaacaugaucgaccccuggaucaugaacaacuucguccagucccccgagggcgaguucaccaucucccccaacaacacccccggcgacauccucuucgaccuccagcucggcccccaccucaaccccuuccuccagcaccucucccagauguacaacggcugggucggcaacaugcgcguccgcauccuccucgccggcaacgccuucuccgccggcaagaucaucaucugcugcgucccccccggcuucaccgcccagaacaucuccaucgcccaggccaccauguucccccacgucaucgccgacguccgcguccucgagcccaucgagaucccccucgacgacguccgcaacguccucuuccacaccaacgagaacaagcccaccaugcgccuccucugcaugcucuacaccccccuccgcgccggcggcgccuccgccggcaccgaccccuucgucaucgccggccgcguccucaccugccccucccccgacuucaacuuccucuuccucgucccccccuccgucgagcagaagacccgccagcucaccguccccaacaucccccucaacaaccucuccaacucccgcguccccgccaugaucuccaagauggccaucuccuccgacgccaaccaggucguccaguuccagaacggccgcugcaccaccgacggccagcuccucggcaccacccccaucuccgccucccaggucgcccgcauccgcggcaaggucuucuccaccuccuccggcaagggccucaaccucuccgagcucgacggcucccccuaccacgccuucgagucccccgcccccgucggcuuccccgaccucggcuacugcgacuggcacgucuccuccuucaaggccgaccacaacuccuccuccgaccccaucucccgccucgacaucaagcagggcgccuccuucgccccccaccucggcuccaucgaguacaccaccucccagaaccccgacggcgaccagcucggcacccucaccuggaucuccucccccuccgacgacacccccggccacggcaccaucaaccucuggaagauccccuccuacggcuccaccgucaccgaguccguccaccucgccccccccaucuacccccccggcuucggcgagacccucgucuacuucauguccgacuuccccaucggccacaccaacuccaacauggcccagguccccugcacccucccccaggaguucgucgcccacuucgucaacgagcaggcccccguccgcggcgacgccgcccuccuccacuacgucgaccccgacacccaccgcaaccucggcgaguucaagcucuaccccgagggcuacaucaccugcguccccaacaccggcggcggcggcccccagucccuccccaucaacggcgucuucaucuucuccuccugggucucccgcuacuaccagcucaagcccgucggcaccgccggccccgcccgccgccucuga

SEQ ID NO: 15708 - RNA, 1626 nt, Artificial Sequence
  derived and/or modified sequence opt2 from VP1__Norovirus_and/or_Norovirus-like__AY675555
augaagauggccuccaaggacgcccccuccaacauggacggcaccuccggcgccggccagcucguccccgaggccaacaccgccgaccccaucccccucgagcccgucgucggcgccgccaccgccgccgccaccgccggccaggucaacaugaucgaccccuggaucaugaacaacuucguccagucccccgagggcgaguucaccaucucccccaacaacacccccggcgacauccucuucgaccuccagcucggcccccaccucaaccccuuccuccagcaccucucccagauguacaacggcugggucggcaacaugcgcguccgcauccuccucgccggcaacgccuucuccgccggcaagaucaucaucugcugcgucccccccggcuucaccgcccagaacaucuccaucgcccaggccaccauguucccccacgucaucgccgacguccgcguccucgagcccaucgagaucccccucgacgacguccgcaacguccucuuccacaccaacgagaaccgccccaccaugcgccuccucugcaugcucuacaccccccuccgcgccggcggcgccuccgccggcaccgaccccuucgucaucgccggccgcguccucaccugccccucccccgacuucaacuuccucuuccucgucccccccuccgucgagcagaagacccgccagcucaccguccccaacaucccccucaacaaccucuccaacuccuccguccccgccaugaucaacaagauggccaucuccuccgacgccaaccaggucguccaguuccagaacggccgcugcaccaccgacggccagcuccucggcaccacccccaucuccgccucccaggucgcccgcauccgcggcaaggucuucuccaccuccuccggcaagggccucaaccucuccgagcucgacggcucccccuaccacgccuucgagucccccgcccccgucggcuuccccgaccucggccacugcgacuggcacgucuccuccuucaaggccgaccagaacuccuccggcgaccccaucucccgccucgacaucaagcagggcgccuccuucgccccccaccucggcuccaucgaguacaccaccucccagaaccccgacggcggccagcucggcacccucaccuggaucuccucccccuccgacgacacccccggccacggcaccaucaaccucuggaagauccccuccuacggcuccaccgucaccgaguccguccaccucgccccccccaucuacccccccggcuucggcgagacccucgucaaccucauguccaacuuccccaucggccacaccaacuccaacauggcccagguccccugcacccucccccaggaguucgucgcccacuucgucaacgagcaggcccccguccgcggcgacgccgcccuccuccacuacgucgaccccgacacccaccgcaaccucggcgaguucaagcucuaccccgagggcuacaucaccugcguccccaacaccggcggcggcggcccccagucccuccccaccaacggcgucuucaucuucuccuccugggucucccgcuacuaccagcucgagcccgucggcaccgccggccccgcccgccgccucuga

SEQ ID NO: 15709 - RNA, 1626 nt, Artificial Sequence
  derived and/or modified sequence opt2 from VP1__Norovirus_and/or_Norovirus-like__EU085479
augaagauggccuccuccgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcaccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccuccgacuucgaccagaaccagcccacccgcuucacccccgucggcaucggcgucgaccacgagaccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcuccggcuga

SEQ ID NO: 15710 - RNA, 1626 nt, Artificial Sequence
  derived and/or modified sequence opt2 from VP1__Norovirus_and/or_Norovirus-like__AF542090
auggccuccaaggacgcccccgucuccggcaccgacggcgccgccggccucguccccgagucccagcaggagguccucccccucgagcccgucgccggcguccagcucgccgcccccgucgccggccaguccaacaucaucgaccccuggauccgcaugaacuucguccaggcccccgccggcgaguucaccgucuccccccgcaacgcccccggcgagguccucaucgaccucgagcucggccccgagcucaaccccuaccucaaccaccucgcccgcauguacaacggcuacgucggcggcauggaggucgaggucguccucgccggcaacgccuucaccgccggcaagguccucuucgccgccgucccccccuccuuccccacccacggcaucaccgccgcccaggccaccaugcucccccacgucaucgucgacguccgccagcucgagcccguccgccucccccuccccgacguccgcaacgucauguuccacuucugccaggagaacaaggagccccgcaugcgcaucgucgccauccucuacaccccccuccgcgccaacggcgccggcgacgacgucuucaccgucuccugccgcguccucacccgccccucccccgacuucgacuucaucuuccucgucccccccuccgucgaguccaagcucaagcaguucacccuccccaaccuccagcccaacgagaugaccaacucccgcuuccccaccuccgucacccagcucuacaccucccccaacaccaaccucgucguccaguuccagaacggccgcugccagcucgacggcacccuccucggcaccacccccguccgcgccgccgacaucugcuccuuccgcggcaucaccuccgccgaggucgacaccaccgacuccucccgcgucgccggcucccaccgcgucaugguccagcucaaggagcccgacggcgaggaguucucccccaccggccccaaccccgcccccgucggcacccccgacuuccaggccgccaucuucggcacccucucccagcgcaacaacaccggcggcuccggccagaacuccaaccgcucccacuucgccuacuucuacacccgcaaccccaccuucgcccccggcaucggcaccgucgucuucuccuucgacaccaccgacuuccagaaccgccagcccaccaaguucucccccuccggcgucuacgacgacgacuccuccgagcccuucaaccaguucucccuccccuacuacaacggcucccucggcgccgucgacgccggcaagcucgccccccccgucgcccccaacuaccccggcgagcagauccucuacuuccgcggcaacauccccuucaagggcggcuacggcggcggcgagaucgacugccuccucccccaggaguggaucacccaccucuacgccgagcaggcccccacccagggcgacgccgcccuccuccgcuacuacaaccccgacaccggccgcguccucuucgagugcaagcuccaccgcgagggcuucaucaccaucaacuacaccggcuccaacgcccucgccguccccgucaacggcgucuuccgcuucgagggcugggucaacaaguucuacacccucacccccauguga

SEQ ID NO: 15711 - RNA, 1623 nt, Artificial Sequence
  derived and/or modified sequence opt2 from VP1__Norovirus_and/or_Norovirus-like__KM386680
augaagauggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccccccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccucgagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 15712 - RNA, 1623 nt, Artificial Sequence
  derived and/or modified sequence opt2 from VP1__Norovirus_and/or_Norovirus-like__AF397156
augaagauggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccucgagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgaccccuggggcaaccaguucuacucccucgcccccaugggcaccggcaacggccgccgccgcuuccaguga

SEQ ID NO: 15713 - RNA, 1623 nt, Artificial Sequence
  derived and/or modified sequence opt2 from VP1__Norovirus_and/or_Norovirus-like__AF414422
augaagauggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagccccaggccugcaacaucugcuccauccgcggcaaggucaccggccagguccccaacgagcagcacaccuggaaccucgagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuucggcuucgacuccugggucaaccaguucuacucccucgcccccaugggcaccggcaacggccgccgccgcuuccaguga

SEQ ID NO: 15714 - RNA, 1623 nt, Artificial Sequence
  derived and/or modified sequence opt2 from VP1__Norovirus_and/or_Norovirus-like__AF414423
augaagauggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgaguccggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccccuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcggccuccucggcaccacccagcuccaggccugcaacaucugcuccauccgcggcaaggucaccggccagguccccuccgagcagcacauguggaaccucgagaucaccaaccucaacggcacccaguucgaccccaccgacgacguccccgccccccucggcguccccgacuucgccggcgaggucuucggcguccucucccagcgcaaccgcggcgaguccaacuccgccaaccgcgcccacgacgccgucgucgccaccuacuccgacaaguacacccccaagcucggccucguccagaucggcaccuggaacaccaacgacgucgagaaccagcccaccaaguucacccccaucggccucaacggcgucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 15715 - RNA, 1623 nt, Artificial Sequence
  derived and/or modified sequence opt2 from VP1__Norovirus_and/or_Norovirus-like__GQ856476
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacaaccagcaguccgaccagcgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccaucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucgccgacgaccgccaccucuggaacauccaggucuccaaccucaacggcacccccuucgaccccaccgacgacguccccgccccccucggcaugcccgacuucuccggccagaucuucggcgucgucucccagcgcgacaccggcaccaaccccgccaaccgcgcccacgacgccguccucgccaccuacuccgccaaguacacccccaagcucggcuccguccagaucggcaccugggacaccgaggaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggccacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaagggcggcuucaucaccgucuccuccaccgagaaccgccccgucaucgucccccccaacggcuacuuccgcuucgacuccugggucaaccaguucuacucccucgcccccaugggcaccggcaacggccgccgccgcaugcaguga

SEQ ID NO: 15716 - RNA, 1623 nt, Artificial Sequence
  derived and/or modified sequence opt2 from VP1__Norovirus_and/or_Norovirus-like__AJ277607
augaagauggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucucccccaagaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucuacggcgagcuccucggcaccgcccagcuccaggccugcaacaucugcuccauccgcggcaaggucaccggccaguuccccaacgagcagaacauguggaaccucgagaucaccaaccucaacggcacccaguucgaccucaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 15717 - RNA, 1623 nt, Artificial Sequence
  derived and/or modified sequence opt2 from VP1__Norovirus_and/or_Norovirus-like__AY772730
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucgcccgcauguacaacggcuacgccggcggcgucgagguccagguccuccucgccggcuccgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacaaccagcaguccgaccagcgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccaucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucuccgacgaccgccaccucuggaacauccaggucuccaaccucaacggcacccccuucgaccccaccgacgacguccccgccccccucggcaugcccgacuucuccggccagaucuucggcgucgucucccagcgcgacaccggcaccaaccccgccaaccgcgcccacgacgccgcccucgccaccuacuccgccaaguacacccccaagcucggcuccguccagaucggcgccugggacaccgaggaccuccucgagcgccagcccgucaaguucucccccgucggccucuccgagaucggccaggacaagcacuucgaccaguggguccuccccaacuacuccggcgcccucggccucaacguccaccucgcccccgccgucuccccccucuuccccggcgagcgccuccucuucuuccgcuccuacaucccccucaagggcggccacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaaggagggcuucaucaccgucuccuccaccgagaaccgccccgucaucgucccccccaacggcuacuuccgcuucgacuccugggucaaccaguucuacucccucgcccccaugggcaccggcaacggccgccgccgcaugcaguga

SEQ ID NO: 15718 - RNA, 1623 nt, Artificial Sequence
  derived and/or modified sequence opt2 from VP1__Norovirus_and/or_Norovirus-like__KT315718
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccgacuccacccgcgcccagcaggccuccgucuccaccuacuccccccaguucguccccaagcucggcuccgucaaccuccgcaucuccaacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15719 - RNA, 1623 nt, Artificial Sequence
  derived and/or modified sequence opt2 from VP1__Norovirus_and/or_Norovirus-like__KT315708
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15720 - RNA, 1623 nt, Artificial Sequence
  derived and/or modified sequence opt2 from VP1__Norovirus_and/or_Norovirus-like__KT315697
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcgcccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15721 - RNA, 1623 nt, Artificial Sequence
  derived and/or modified sequence opt2 from VP1__Norovirus_and/or_Norovirus-like__KT315689
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucucccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15722 - RNA, 1623 nt, Artificial Sequence
  derived and/or modified sequence opt2 from VP1__Norovirus_and/or_Norovirus-like__KX216805
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15723 - RNA, 1623 nt, Artificial Sequence
  derived and/or modified sequence opt2 from VP1__Norovirus_and/or_Norovirus-like__KU557859
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcgucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15724 - RNA, 1623 nt, Artificial Sequence
  derived and/or modified sequence opt2 from VP1__Norovirus_and/or_Norovirus-like__KU557828
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccgacuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15725 - RNA, 1623 nt, Artificial Sequence
  derived and/or modified sequence opt2 from VP1__Norovirus_and/or_Norovirus-like__KT315692
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucucccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15726 - RNA, 1623 nt, Artificial Sequence
  derived and/or modified sequence opt2 from VP1__Norovirus_and/or_Norovirus-like__KX168437
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagguccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15727 - RNA, 1623 nt, Artificial Sequence
  derived and/or modified sequence opt2 from VP1__Norovirus_and/or_Norovirus-like__KX168440
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggguccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15728 - RNA, 1623 nt, Artificial Sequence
  derived and/or modified sequence opt2 from VP1__Norovirus_and/or_Norovirus-like__KX216793
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcucguccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15729 - RNA, 1623 nt, Artificial Sequence
  derived and/or modified sequence opt2 from VP1__Norovirus_and/or_Norovirus-like__KU557881
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcucccucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15730 - RNA, 1623 nt, Artificial Sequence
  derived and/or modified sequence opt2 from VP1__Norovirus_and/or_Norovirus-like__KY424350
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacaaccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccaucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15731 - RNA, 1623 nt, Artificial Sequence
  derived and/or modified sequence opt2 from VP1__Norovirus_and/or_Norovirus-like__KU557884
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcgccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15732 - RNA, 1623 nt, Artificial Sequence
  derived and/or modified sequence opt2 from VP1__Norovirus_and/or_Norovirus-like__KU561253
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccacaccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15733 - RNA, 1623 nt, Artificial Sequence
  derived and/or modified sequence opt2 from VP1__Norovirus_and/or_Norovirus-like__KP902588
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuccguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15734 - RNA, 1623 nt, Artificial Sequence
  derived and/or modified sequence opt2 from VP1__Norovirus_and/or_Norovirus-like__KX168456
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacggcggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15735 - RNA, 1623 nt, Artificial Sequence
  derived and/or modified sequence opt2 from VP1__Norovirus_and/or_Norovirus-like__KX168444
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccucccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15736 - RNA, 1623 nt, Artificial Sequence
  derived and/or modified sequence opt2 from VP1__Norovirus_and/or_Norovirus-like__KX216806
augaagauggccaccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15737 - RNA, 1623 nt, Artificial Sequence
  derived and/or modified sequence opt2 from VP1__Norovirus_and/or_Norovirus-like__KX216794
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucugcgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15738 - RNA, 1623 nt, Artificial Sequence
  derived and/or modified sequence opt2 from VP1__Norovirus_and/or_Norovirus-like__KX420895
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacgcccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccuccuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15739 - RNA, 1623 nt, Artificial Sequence
  derived and/or modified sequence opt2 from VP1__Norovirus_and/or_Norovirus-like__KT591501
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagauccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15740 - RNA, 1623 nt, Artificial Sequence
  derived and/or modified sequence opt2 from VP1__Norovirus_and/or_Norovirus-like__KT315714
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccuggaucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15741 - RNA, 1623 nt, Artificial Sequence
  derived and/or modified sequence opt2 from VP1__Norovirus_and/or_Norovirus-like__KT315673
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucucccccaagaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15742 - RNA, 1623 nt, Artificial Sequence
  derived and/or modified sequence opt2 from VP1__Norovirus_and/or_Norovirus-like__KX216792
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcacaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaacuuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15743 - RNA, 1623 nt, Artificial Sequence
  derived and/or modified sequence opt2 from VP1__Norovirus_and/or_Norovirus-like__KU953398
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15744 - RNA, 1623 nt, Artificial Sequence
  derived and/or modified sequence opt2 from VP1__Norovirus_and/or_Norovirus-like__KU557888
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcuccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15745 - RNA, 1623 nt, Artificial Sequence
  derived and/or modified sequence opt2 from VP1__Norovirus_and/or_Norovirus-like__KU557808
augaagauggccuccaacgacgucgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggguccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15746 - RNA, 1623 nt, Artificial Sequence
  derived and/or modified sequence opt2 from VP1__Norovirus_and/or_Norovirus-like__KU557807
augaagauggccuccaacgacgucgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15747 - RNA, 1623 nt, Artificial Sequence
  derived and/or modified sequence opt2 from VP1__Norovirus_and/or_Norovirus-like__KX371111
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15748 - RNA, 1623 nt, Artificial Sequence
  derived and/or modified sequence opt2 from VP1__Norovirus_and/or_Norovirus-like__KX371110
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcacgaccgcuggcacaugcagcuccagaaccucaacggcaccaccuacgaccccaccgacgacguccccgccccccucggcacccccgacuucaagggcgucgucuucggcauggucucccagcgcaacgucggcaccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15749 - RNA, 1623 nt, Artificial Sequence
  derived and/or modified sequence opt2 from VP1__Norovirus_and/or_Norovirus-like__KX134669
augaagauggccuccuccgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15750 - RNA, 1623 nt, Artificial Sequence
  derived and/or modified sequence opt2 from VP1__Norovirus_and/or_Norovirus-like__KU557871
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacgcccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15751 - RNA, 1623 nt, Artificial Sequence
  derived and/or modified sequence opt2 from VP1__Norovirus_and/or_Norovirus-like__KX371108
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagauccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15752 - RNA, 1623 nt, Artificial Sequence
  derived and/or modified sequence opt2 from VP1__Norovirus_and/or_Norovirus-like__KU557829
augaagauggccuccaacgacgccgcccccuccaacgacggcgccgccggccucguccccgagggcaacaacgagacccucccccucgagcccgucgccggcgccgccaucgccgcccccgucaccggccagaacaacaucaccgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccgacuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15753 - RNA, 1623 nt, Artificial Sequence
  derived and/or modified sequence opt2 from VP1__Norovirus_and/or_Norovirus-like__KX168452
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccgcccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15754 - RNA, 1623 nt, Artificial Sequence
  derived and/or modified sequence opt2 from VP1__Norovirus_and/or_Norovirus-like__KU953393
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccuccaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15755 - RNA, 1623 nt, Artificial Sequence
  derived and/or modified sequence opt2 from VP1__Norovirus_and/or_Norovirus-like__KR052020
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccagcccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15756 - RNA, 1623 nt, Artificial Sequence
  derived and/or modified sequence opt2 from VP1__Norovirus_and/or_Norovirus-like__KT315687
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccaguccaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15757 - RNA, 1623 nt, Artificial Sequence
  derived and/or modified sequence opt2 from VP1__Norovirus_and/or_Norovirus-like__KX356908
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccucuccuccgacaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgaccacccccucgucguccccgccaacggccacuuccgcuucgacuccugggucaaccaguucuacucccucgcccccaugggcaccggcaacggccgccgccgcgcccaguga

SEQ ID NO: 15758 - RNA, 1623 nt, Artificial Sequence
  derived and/or modified sequence opt2 from VP1__Norovirus_and/or_Norovirus-like__KX024652
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccaccccaccaaguucacccccgucggcgucaacgacgacaacgacggcccccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15759 - RNA, 1623 nt, Artificial Sequence
  derived and/or modified sequence opt2 from VP1__Norovirus_and/or_Norovirus-like__KT315706
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccaccuccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15760 - RNA, 1623 nt, Artificial Sequence
  derived and/or modified sequence opt2 from VP1__Norovirus_and/or_Norovirus-like__KX134670
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucaccaugcccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15761 - RNA, 1623 nt, Artificial Sequence
  derived and/or modified sequence opt2 from VP1__Norovirus_and/or_Norovirus-like__KT780399
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugcaccguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15762 - RNA, 1623 nt, Artificial Sequence
  derived and/or modified sequence opt2 from VP1__Norovirus_and/or_Norovirus-like__KP902577
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugcaccguccucaccacccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15763 - RNA, 1623 nt, Artificial Sequence
  derived and/or modified sequence opt2 from VP1__Norovirus_and/or_Norovirus-like__KU587628
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccuacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaacaagcccuucucccuccccaucuucacccucuccgagcucaccaacucccgcuuccccguccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15764 - RNA, 1623 nt, Artificial Sequence
  derived and/or modified sequence opt2 from VP1__Norovirus_and/or_Norovirus-like__AF414409
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucgucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgagaugauguacaccucccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaagaacgagcagaaccccgccacccgcucccacgaggccaacaucaacaccggcggcgaccaguacgcccccaagcucgcccaggucaagaucuucucccagucccaggacuucgagguccaccagcccaccgucuucacccccgucggcgucgccggcgacaccucccaccccuuccgccaguggacccucccccgcuacggcggccaccucaccaacaacacccaccucgcccccgccgucgccccccucuuccccggcgagcagauccucuucuuccgcucccagauccccuccuccggcggccacgagcucggcuacauggacugccucgucccccaggaguggguccagcacuucuaccaggaggccgccaccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcauccaguga

SEQ ID NO: 15765 - RNA, 1623 nt, Artificial Sequence
  derived and/or modified sequence opt2 from VP1__Norovirus_and/or_Norovirus-like__KT943504
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaccaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucgucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgagaugauguacaccgcccgcaacgagaaccaggucguccagccccagaacggccgcgucacccucgacggcgagcuccucggcaccaccccccuccucgccgucaacaucugcaaguucaagggcgagaucaccgccaaguccgucgacguccgcuccuaccgcauggacauggagaucaccaacaccgacggcacccccaucgaccccaccgaggacacccccggccccaucggcucccccgacuuccgcggcauccucuucggcgucgccucccagcgcaacaagggcgagcagauccccgccacccgcgcccacgaggccaacaucaacaccggcggcgaccaguacgcccccaagcucgcccaggucaaguucuucuccggcucccaggacuucgagguccaccagcccaccgucuucacccccgucggcgucgccggcgacuccucccaccccuuccagcagugggcccucccccgcuacggcggccaccucaccaacaacacccaccucgcccccgccgucgccccccucuuccccggcgagcagauccucuucuuccgcucccagauccccuccuccggcggccacgagaugggcuacauggacugccucgucccccaggaguggguccagcacuucuaccaggaggccgccaccgcccaguccgaggucgcccucauccgcuucgucaaccccgacaccggccgcguccucuucgaggccaagcuccacaagcagggcuucaucaccgucgcccacaccggcgacaaccccaucgucaugccccccaacggccacuuccgcuucgaggccugggucaaccaguucuacucccucgcccccgucggcaccggcaacggccgccgccgcauccaguga

SEQ ID NO: 15766 - RNA, 1623 nt, Artificial Sequence
  derived and/or modified sequence opt2 from VP1__Norovirus_and/or_Norovirus-like__KT943505
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaccaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucgucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgagaugauguacaccgcccgcaacgagaaccaggucguccagccccagaacggccgcgucacccucgacggcgagcuccucggcaccaccccccuccucgccgucaacaucugcaaguucaagggcgagaucaccgccaaguccgucgacguccgcuccuaccgcauggacauggagaucaccaacaccgacggcacccccaucgaccccaccgaggacacccccggccccaucggcucccccgacuuccgcggcauccucuucggcgucgccucccagcgcaacaagggcgagcagauccccgccacccgcgcccacgaggccaacaucaacaccggcggcgaccaguacgcccccaagcucgcccaggucaaguucuucuccggcucccaggacuucgagguccaccagcccaccgucuucacccccgucggcgucgccggcgacuccucccaccccuuccagcagugggcccucccccgcuacggcggccaccucaccaacaacacccaccucgcccccgccgucgccccccucuuccccggcgagcagauccucuucuuccgcucccagauccccuccuccggcggccacgagcucggcuacauggacugccucgucccccaggaguggguccagcacuucuaccaggaggccgccaccgcccaguccgaggucgcccucauccgcuucgucaaccccgacaccggccgcguccucuucgaggccaagcuccacaagcagggcuucaucaccgucgcccacaccggcgacaaccccaucgucaugccccccaacggccacuuccgcuucgaggccugggucaaccaguucuacucccucgcccccgucggcaccggcaacggccgccgccgcauccaguga

SEQ ID NO: 15767 - RNA, 1623 nt, Artificial Sequence
  derived and/or modified sequence opt2 from VP1__Norovirus_and/or_Norovirus-like__KT962982
augaagauggccuccaacgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuacaagggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcaaccaccccacccaggagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcgcccaguga

SEQ ID NO: 15768 - RNA, 1623 nt, Artificial Sequence
  derived and/or modified sequence opt2 from VP1__Norovirus_and/or_Norovirus-like__KX079488
augaagauggccuccaacgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcaaccaccccacccaggagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcgcccaguga

SEQ ID NO: 15769 - RNA, 1623 nt, Artificial Sequence
  derived and/or modified sequence opt2 from VP1__Norovirus_and/or_Norovirus-like__KR921938
augaagauggccuccaacgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcaaccaccccacccaggagaucgacugccucaucccccaggaguggaucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcgcccaguga

SEQ ID NO: 15770 - RNA, 1623 nt, Artificial Sequence
  derived and/or modified sequence opt2 from VP1__Norovirus_and/or_Norovirus-like__KR921940
augaagauggccuccaacgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcaaccaccccacccaggagaucgacugccucaucccccaggagugggucucccacuucuaccaggaguccgcccccucccaguccgacgucgcccucguccgcuacgucaaccccgacaccggccgcaccaccuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcgcccaguga

SEQ ID NO: 15771 - RNA, 1623 nt, Artificial Sequence
  derived and/or modified sequence opt2 from VP1__Norovirus_and/or_Norovirus-like__DQ358209
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucgucuucgccgccaucccccccggcuuccccuacgagaaccucucccccucccagaucaccaugugcccccacgucaucaucgacguccgccagcucgagcccguccuccuccucaugcccgacaucaagaacaacuucuuccacuacaaccagggcaacgaccccaagcuccgccucgucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgagaugauguacaccgcccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaagaacgagcagaaccccgccacccgcgcccaggaggucaacaucaacaccggcggcgaccaguacgcccccaagcucgcccaggucaaguucuucuccgagucccaggacuucgagguccaccagcccaccgucuucacccccgucggcgucgccggcgaccccucccaccccuuccgccaguggacccucccccgcuacggcggccaccucaccaacaacauccaccucgcccccgccgucgccccccucuuccccggcgagcagauccucuucuuccgcucccagauccccuccuccggcggccacgagcucggcuacauggacugccucgucccccaggaguggguccagcacuucuaccaggaggccgccaccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcguccaguga

SEQ ID NO: 15772 - RNA, 1623 nt, Artificial Sequence
  derived and/or modified sequence opt2 from VP1__Norovirus_and/or_Norovirus-like__KP784694
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgacccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccacccagaacuggaacuccuacgaccccaccgaggagauccccgccccccucggcacccccgacuucgucggcaagauccagggcguccucacccagaccaccaagaccgacggcuccacccgcucccacaaggccaccgucuacaccggcuccgccgacuucgcccccaagcucggccgcguccaguucgagaccgacaccaacaacgacuucgagaccaaccagaacaccaaguucacccccgucggcgucauccagaacggcgagaccgcccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggcucccacgaccucgucaucccccccaacggcuacuuccgcuucgacuccugggucaaccaguucuacacccucgcccccaugggcaacggcaccggccgccgccgcgccaccuga

SEQ ID NO: 15773 - RNA, 1623 nt, Artificial Sequence
  derived and/or modified sequence opt2 from VP1__Norovirus_and/or_Norovirus-like__KX354064
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccauguga

SEQ ID NO: 15774 - RNA, 1623 nt, Artificial Sequence
  derived and/or modified sequence opt2 from VP1__Norovirus_and/or_Norovirus-like__LC177658
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgucgccuga

SEQ ID NO: 15775 - RNA, 1623 nt, Artificial Sequence
  derived and/or modified sequence opt2 from VP1__Norovirus_and/or_Norovirus-like__KX514232
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcgccuccuga

SEQ ID NO: 15776 - RNA, 1623 nt, Artificial Sequence
  derived and/or modified sequence opt2 from VP1__Norovirus_and/or_Norovirus-like__LC145787
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacguccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacgucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15777 - RNA, 1623 nt, Artificial Sequence
  derived and/or modified sequence opt2 from VP1__Norovirus_and/or_Norovirus-like__KT962983
augaagauggccuccaacgacgccgcccccuccaccgacggcgccgccggccucguccccgaguccaacaccgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15778 - RNA, 1623 nt, Artificial Sequence
  derived and/or modified sequence opt2 from VP1__Norovirus_and/or_Norovirus-like__AB629946
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuucaccgucuccaucgaccagauguacaccucccucaacgaggucaucuccguccagugccagaacggccgcugcacccucgacggcgagcuccgcggcaccacccagcuccaggucuccggcaucugcgccuucaagggcgaggucaccgcccacguccacgacaacgaccaccucuacaacgucaccaucaccaaccucaacggcucccccuucgaccccuccgaggacguccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacgucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15779 - RNA, 1623 nt, Artificial Sequence
  derived and/or modified sequence opt2 from VP1__Norovirus_and/or_Norovirus-like__AB809993
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcuga

SEQ ID NO: 15780 - RNA, 1623 nt, Artificial Sequence
  derived and/or modified sequence opt2 from VP1__Norovirus_and/or_Norovirus-like__JQ743330
augaugauggccuccaaggacgccccccccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucauccgcuccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucgacaccggcgacgucaucaagcagaucaacgucaagcaggaggccgccuucgccccccaccucggcaccauccaggccgacggccucuccgacgucuccgucaacaccaacaugaucgccaagcucggcugggucucccccgucuccgacggccaccgcggcuccgucgaccccugggucaucccccgcuacggcuccacccucaccgaggccgcccagcucgccccccccaucuacccccccggcuucggcgaggccaucgucuucuucauguccgacuuccccaucgcccacggcgccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgagggcuucaugaccugcguccccaacuccuccggcaccggcccccagacccuccccaucaacggcgucuucgccuucgucuccugggucucccgcuucuaccagcucaagcccgucggcaccgccggccccgcccgccgccucuga

SEQ ID NO: 15781 - RNA, 1623 nt, Artificial Sequence
  derived and/or modified sequence opt2 from VP1__Norovirus_and/or_Norovirus-like__AF439267
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccgucggcuuccccgaccucggcgagugcgacuggcacauggaggccucccccaccacccaguucaacaccggcgacgucaucaagcagaucaacgucaagcaggaguccgccuucgccccccaccucggcaccauccaggccgacggccucuccgacgucuccgucaacaccaacaugaucgccaagcucggcugggucucccccgucuccgacggccacaagggcgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacuccuccggcaccggcccccagacccuccccaucaacggcgucuucgucuucgucuccugggucucccgcuucuaccagcucaagcccgucggcaccgccggccccgcccgccgccucuga

SEQ ID NO: 15782 - RNA, 1623 nt, Artificial Sequence
  derived and/or modified sequence opt2 from VP1__Norovirus_and/or_Norovirus-like__EF547393
augaugauggccuccaagggcgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgucgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucaacaccggcgacgucaucaagcagaucaacgucaagcaggaguccgccuucgccccccaccucggcaccauccaggccgacggccucuccgacgucuccgucaacaccaacaugaucgccaagcucgagugggucucccccgucuccgacggccacaagggcgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacuccuccggcaccggcccccagacccuccccaucaacggcgucuucgucuucgucuccugggucucccgcuucuaccagcucaagcccgucggcaccgccggccccgcccgccgccucuga

SEQ ID NO: 15783 - RNA, 1623 nt, Artificial Sequence
  derived and/or modified sequence opt2 from VP1__Norovirus_and/or_Norovirus-like__AF145709
augaugauggccuccaaggacgccccccccaacauggacggcaccuccggcgccggccagcucauccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagaugaagguccuccucgccggcaacgccuucaccgccggcaagaucaucaucuccugcaucccccccggcuucgccgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgcccucgacggcucccccuaccacgccuucgagucccccgcccccaucggcuuccccgaccucggcgagugcgacuggcacauggaggccucccccaccacccaguucgacaccggcgacgucaucaagcagaucaacgucaagcaggaguccgccuucgccccccaccucggcaccauccaggccgacggccucuccgacgucuccgucaacaccaacaugaucgccaagcucggcugggucucccccgucuccgacggccaccgcggcaacgucgaccccugggucaucccccgcuacggcuccacccucaccgaggccgcccagcucgccccccccaucuacccccccggcuucggcgaggccaucgucuucuucauguccgacuucuccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgagggcuucaugaccugcguccccaacuccuccggcaccggcccccagacccuccccaucaacggcgucuucgucuucgucuccugggucucccgcuucuaccagcucaagcccgucggcaccgccggccccgcccgccgccucuga

SEQ ID NO: 15784 - RNA, 1623 nt, Artificial Sequence
  derived and/or modified sequence opt2 from VP1__Norovirus_and/or_Norovirus-like__FJ711163
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacguccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacuucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugaugaucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaucacccaguucgacaccggcgacgucaucaagcagaucaacgucaagcaggaguccgccuucgccccccaccucggcaccguccaggccgacggccucuccgacgucuccgccaacaccaacaugaucgccaagcucggcugggucucccccgucuccgacggccaccgcuccgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacuccuccggcaccggcccccagacccuccccaucaacggcgucuucgucuucgucuccugggucucccgcuucuaccagcucaagcccgucggcaccgccggccccgcccgccgccucuga

SEQ ID NO: 15785 - RNA, 1623 nt, Artificial Sequence
  derived and/or modified sequence opt2 from VP1__Norovirus_and/or_Norovirus-like__FJ711164
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacguccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgucgcccagaacuucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccggcggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugaugaucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucgacaccggcgacgucaucaagcagaucaacgucaagcaggaguccgccuucgccccccaccucggcaccguccaggccgacggccucuccgacgucuccgccaacaccaacaugaucgccaagcucggcugggucucccccgucuccgacggccaccgcuccgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacuccuccggcaccggcccccagacccuccccaucaacggcgucuucgucuucgucuccugggucucccgcuucuaccagcucaagcccgucggcaccgccggccccgcccgccgccucuga

SEQ ID NO: 15786 - RNA, 1623 nt, Artificial Sequence
  derived and/or modified sequence opt2 from VP1__Norovirus_and/or_Norovirus-like__AF414405
augaugauggccuccaaggacgccccccccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucgacaccggcgacgucaucaagcagaucaacgucaagcaggaguccgccuucgccccccaccucggcaccauccaggccggcggccucuccgacgucuccgucaacaccaacaugaucgccaagcucggcugggucucccccgucuccgacggccaccgcggcaacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccuucaccaucccccaggaguucgucacccacuucgucaacgagcaggcccccacccgcggcgaggccgcccuccucuacuaccucgaccccgacacccaccgcaaccucggcgaguucaagcucuaccccgagggcuucaugaccugcguccccaacuccuccggcaccggcccccagacccuccccaucaacggcgucuucgucuucgucuccugggucucccgcuucuaccagcucaagcccgucggcaccgccggccccgcccgccgccucuga

SEQ ID NO: 15787 - RNA, 1623 nt, Artificial Sequence
  derived and/or modified sequence opt2 from VP1__Norovirus_and/or_Norovirus-like__AB022679
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagcgcguccucaaccucaccgagcucgacggcucccccuucaugggcuucggcgcccccgcccccgccggcuuccccgaccucggcuccugcgacuggcacaucgagauguccaagauccccaacuccuccacccagaacaaccccaucgucaccaacuccgucaagcccaacucccagcaguucgucccccaccucuccuccaucacccucgacgagaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15788 - RNA, 1623 nt, Artificial Sequence
  derived and/or modified sequence opt2 from VP1__Norovirus_and/or_Norovirus-like__AF414403
augaugauggccuccaaggacgccccccccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucucccuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucgcccucgacggccagcuccagggcaccacccccaccuccgccucccagcucugcaagauccgcggcuccgucuuccacgccaacggcggcaacggcuacaaccccaccgagcucgacggcucccccuaccacgccuucgagucccccgcccccaucggcuuccccgaccucggcgagugcgacuggcacauggaggccucccccaccacccaguucgacaccggcgacgucaucaagcagaucaacgucaagcaggaguccgccuucgccccccaccucggcaccauccaggccgacggccucuccgacgucuccgucaacaccaacaugaucgccaagcucggcugggucucccccgucuccgacggccaccgcggcaacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgagggcuucaugaccugcguccccaacuccuccggcaccggcccccagacccuccccaucaacggcgucuucgucuucgucuccugggucucccgcuucuaccagcucaagcccgucggcaccgccggccccgcccgccgccucuga

SEQ ID NO: 15789 - RNA, 1623 nt, Artificial Sequence
  derived and/or modified sequence opt2 from VP1__Norovirus_and/or_Norovirus-like__LC101821
augaugauggccuccaaggacgccgcccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgucggcuuccccgaccucggcuccugcgacuggcacaucgagauguccaagauccccaacuccuccacccaguccaaccccaucgucgucaacuccgucaagcccaacucccagcaguucgucccccaccucuccuccaucacccucgacgacaacgucuccuccggcggcgacuacaucggcaccauccaguggaccuccccccccuccggcuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15790 - RNA, 1623 nt, Artificial Sequence
  derived and/or modified sequence opt2 from VP1__Norovirus_and/or_Norovirus-like__AY038598
augaugauggccuccaaggacgccccccccaacauggacggcaccuccggcgccggccagcucguccccgaggccaacaccgccgagcccaucuccauggagcccgucgccggcgccgccaccgccgccgccaccgccggccaggucaacaugaucgaccccuggaucauggacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacaucuccaucgcccaggccaccauguucccccacgucaucgccgacguccgcguccucgaccccaucgaggucccccucgaggacgucggcaacguccucuuccacaacaacggcgacacccccaccaugcgccucgucugcaugcucuacaccccccuccgcgccuccggcuccuccuccggcaccgaccccuucgucaucgccggccacguccucaccugccccucccccgacuucuccuuccucuuccucggcccccccaacgucgagcagaagaccaagcccuucuccguccccaaccucccccucaacacccucuccaacucccgcguccccucccucauccgcuccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacacccucaccgagcucgacggcucccccuaccacgccuucgagucccccgcccccaucggcuuccccgaccucggcgagugcgacuggcacauggaggccucccccaccacccaguucgacaccggcgacgucaucaagcagaucaacgucaagcaggaggccgccuucgccccccaccucggcaccauccaggccgacggccucuccgacgucuccgucaacaccaacaugaucgccaagcucggcugggucucccccgccuccgacggccaccgcggcaacgucgaccccugggucaucccccgcuacggcuccacccucaccgaggccgcccagcucgccccccccaucuacccccccggcuucggcgaggccaucgucuucuucauguccgacuuccccaucgcccacggcgccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgagggcuucaugaccugcguccccaacuccuccggcaccggcccccagacccuccccaucaacggcgucuucgucuucgucuccugggucucccgcuucuaccagcucaagcccgucggcaccgccggccccgcccgcucccucuga

SEQ ID NO: 15791 - RNA, 1623 nt, Artificial Sequence
  derived and/or modified sequence opt2 from VP1__Norovirus_and/or_Norovirus-like__KJ196292
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgucgcccagaacgucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucaacaccggcgacgucaucaagcagaucaacgucaagcaggaguccgccuucgccccccaccucggcaccauccaggccgacggccucuccgacgucuccgucaacaccaacaugaucgccaagcucggcugggucucccccgucuccgacggccacaagggcgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacuccuccggcaccggcccccagacccuccccaucaacggcgucuucgucuucgucuccugggucucccgcuucuaccagcucaagcccgucggcaccgccggccccgcccgccgccucuga

SEQ ID NO: 15792 - RNA, 1623 nt, Artificial Sequence
  derived and/or modified sequence opt2 from VP1__Norovirus_and/or_Norovirus-like__JQ743331
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgccggcuuccccgaccucggcuccugcgacuggcacaucgagauguccaagauccccaacuccuccacccaguccaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15793 - RNA, 1623 nt, Artificial Sequence
  derived and/or modified sequence opt2 from VP1__Norovirus_and/or_Norovirus-like__EF547394
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgccggcuuccccgaccucggcuccugcgacuggcacaucgaggucuccaagauccccaacuccuccacccaguccaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15794 - RNA, 1623 nt, Artificial Sequence
  derived and/or modified sequence opt2 from VP1__Norovirus_and/or_Norovirus-like__AF394960
augaugauggccuccaaggacgccacccccuccgccgacggcgccaccggcgccggccagcucguccccgaggucaacaccgccggccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgccggcuuccccgaccucggcuccugcgacuggcacaucgagauguccaagauccccaacuccuccacccaguccaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15795 - RNA, 1623 nt, Artificial Sequence
  derived and/or modified sequence opt2 from VP1__Norovirus_and/or_Norovirus-like__AJ277616
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccaagcucgacggcucccccuucauggccuucgccgcccccgcccccgccggcuuccccaaccucggcuccugcgacuggcacaucgagauguccaagauccccaacuccuccacccaguccaaccccaucgucgucaacuccgucaagcccaacucccagcaguucgucccccaccucuccuccaucacccucgacgagaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccucgucuucaacgaggucaucgucuacuucauggccugcauccgcggccccaaccagugcggcucccccaaccucguccccugccucuccccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15796 - RNA, 1623 nt, Artificial Sequence
  derived and/or modified sequence opt2 from VP1__Norovirus_and/or_Norovirus-like__GQ413970
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagcgcguccucaaccucaccgagcucgacggcucccccuucauggccuucgccgcccccgcccccgccggcuuccccgaccucggcuccugcgacuggcacaucgagauguccaagauccccaacuccuccacccagaacaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15797 - RNA, 1623 nt, Artificial Sequence
  derived and/or modified sequence opt2 from VP1__Norovirus_and/or_Norovirus-like__KT732281
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgccggcuuccccgaccucggcuccugcgacuggcacaucgaggucuccaagauccccaacuccuccacccagggcaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15798 - RNA, 1623 nt, Artificial Sequence
  derived and/or modified sequence opt2 from VP1__Norovirus_and/or_Norovirus-like__AF414404
augaugauggccuccaaggacgccacccccuccgccgacggcgccaccggcgccggccagcucguccccgaggucaacaccgccgaccccauccccaucgaccccgucgccggcuccuccaccgcccucgccaccgccggccgcgucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccuccaccacaacaacgacacccagcccaccaugcgccuccucugcaugcucuacaccccccuccgcaccggcggcgccuccggcggcaccgacuccuucgucgucuccggccgcguccucaccugccccggccccgacuucaacuuccucuuccucgucccccccaccgucgagcagaagacccgccccuucaccguccccaacaucccccucaagugccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagggcguccucaaccucaccgagcucgacggcucccccuucauggccuucgccgcccccgcccccgccggcuuccccgaccucggcuccugcgacuggcacaucgagauguccaagauccccaacuccuccacccagaacaaccccaucgucgucaacuccgucaagcccaacucccagcaguucgucccccaccucuccuccaucacccucgacgagaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15799 - RNA, 1623 nt, Artificial Sequence
  derived and/or modified sequence opt2 from VP1__Norovirus_and/or_Norovirus-like__AF414402
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugccgcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgucggccgcguccucaccugccccggccccgacuucaacuuccucuuccucgucccccccaccgucgagcagaagacccgccccuucaccgcccccaacaucccccucaaguaccucuccaacucccgcauccccaaccccaucgagggcaugucccucucccccgaccagacccagaacguccaguuccagaacggccgcugcaccaucgacggccagccccucggcgccacccccgucuccgucucccagcucugcaaguuccgcggccgcaucaccuccggccagcgcgcccucaaccucaccgagcucgacggcucccccuucauggccuucgccgcccccgcccccgccggcuuccccgaccucggcuccugcgacuggcacaucgagauguccaagauccccaacuccuccacccagaacaaccccaucgucgucaacuccgucaagcccaacucccagcaguucgucccccaccuccccuccaucacccucgacgagaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15800 - RNA, 1623 nt, Artificial Sequence
  derived and/or modified sequence opt2 from VP1__Norovirus_and/or_Norovirus-like__AJ313030
augaugauggccuccaaggacgccacccccuccgccgacggcgcccucggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccaguccggccgcugcaccaucgacggccagccccucggcaccacccccgucuccgucucccagcucugcaaguuccgcggccgcaucaccuccggccagaagguccucaaccucaccggccucgacggcucccccuucauggccuucgccgcccccgcccccgccggcuuccccgaccucggcuccugcgacuggcacaucgagauguccaagauccccaacuccuccacccagaacaaccccaucgucaucaacuccgucaagcccaacucccagcaguucgucccccaccucuccuccaucacccucgacgagaacguccucuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcacccgcggccccgcccgcggccgccucuga

SEQ ID NO: 15801 - RNA, 1623 nt, Artificial Sequence
  derived and/or modified sequence opt2 from VP1__Norovirus_and/or_Norovirus-like__KM036381
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgccggcuuccccgaccucggcuccugcgacuggcacaucgagauguccaagauccccaacuccuccaccgaguccaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccaacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15802 - RNA, 1623 nt, Artificial Sequence
  derived and/or modified sequence opt2 from VP1__Norovirus_and/or_Norovirus-like__LN854563
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagcgcguccucaaccucaccgagcucgacggcucccccuucauggccuucgccgcccccgcccccgccggcuuccccgaccucggcuccugcgacuggcacaucgagauguccaagauccccaacuccuccacccagaacaaccccaucgucgucaacuccgucaagcccaacucccagcaguucgucccccaccucuccuccaucacccucgacgacaucgucuccuccggcggcgacuacaucggcaccauccaguggaccuccccccccuccgacuccggcggcgccaacaccaacuucuggaagauccccgacuacggcuccucccucuccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15803 - RNA, 1623 nt, Artificial Sequence
  derived and/or modified sequence opt2 from VP1__Norovirus_and/or_Norovirus-like__AB042808
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagcgcguccucaaccucaccgagcucgacggcucccccuucauggccuucgccgcccccgcccccgccggcuuccccgaccucggcuccugcgacuggcacaucgagauguccaagauccccaacuccuccacccagaacaaccccaucgucaccaacuccgucaagcccaacucccagcaguucgucccccaccucuccuccaucacccucgacgagaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucuga

SEQ ID NO: 15804 - RNA, 1623 nt, Artificial Sequence
  derived and/or modified sequence opt2 from VP1__Norovirus_and/or_Norovirus-like__EU004679
augcgcauguccgacggcgccgcccccaaggccaacggcuccgaggccuccggccaggaccucguccccaccgccaucgagcaggccguccccauccagcccgucgccggcuccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggcaaggucuacgccucccucgccgucgccgccucccucgaccucgucgacggccgcguccgcgccgucccccgcuccaucuacggcuuccaggacgucauccccgaguacaacgacggccuccucgucccccucgccccccccaucggccccuuccuccccggcgagauccuccuccgcuuccgcaccuacaugcgccagcucgacaccgccgacgccgccgccgaggccaucgacugcgcccucccccaggaguucaucuccugguucgccuccaacgccuucaccguccaggccgacgcccuccuccuccgcuaccgcaacacccucaccggccagcuccucuucgagugcaagcucuacuccgagggcuacaucgcccucuccuacuccggcuccgccccccucaccuuccccaccgacggcuucuucgaggucgucuccugggucccccgccucuuccagcucgccuccgucggcucccucaccaccggccgcacccucaaguga

SEQ ID NO: 15805 - RNA, 1623 nt, Artificial Sequence
  derived and/or modified sequence opt2 from VP1__Norovirus_and/or_Norovirus-like__EU004678
augcgcauguccgacggcgccgcccccaaggccaacggcuccgaggccuccggccaggaccucguccccaccgccgucgagcaggccguccccauccagcccgucgccggcuccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggccgcgucuacgccucccucaccgccgucgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucaucuccugguucgccuccaacgccuucaccguccaguccgacgcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuuccagcucgccuccgucggcucccucaccaccggccgcacccucaaguga

SEQ ID NO: 15806 - RNA, 1623 nt, Artificial Sequence
  derived and/or modified sequence opt2 from VP1__Norovirus_and/or_Norovirus-like__AB281085
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaucgccuccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaguccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15807 - RNA, 1623 nt, Artificial Sequence
  derived and/or modified sequence opt2 from VP1__Norovirus_and/or_Norovirus-like__AB662868
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgagcaccucuacaacgucaccaucaucaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccaacaaccagcccgucaaguucacccccgucggccucaacgacaccgagcacuucgaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15808 - RNA, 1623 nt, Artificial Sequence
  derived and/or modified sequence opt2 from VP1__Norovirus_and/or_Norovirus-like__AB662861
augaagauggccuccaacgacgccguccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgagcaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagguccagaucggcaccuggcagaccgacgaccucaccgacaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15809 - RNA, 1623 nt, Artificial Sequence
  derived and/or modified sequence opt2 from VP1__Norovirus_and/or_Norovirus-like__LC145791
augaagauggccuccaacgacgucgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15810 - RNA, 1623 nt, Artificial Sequence
  derived and/or modified sequence opt2 from VP1__Norovirus_and/or_Norovirus-like__LC145790
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15811 - RNA, 1623 nt, Artificial Sequence
  derived and/or modified sequence opt2 from VP1__Norovirus_and/or_Norovirus-like__LC145793
augaagauggccuccaacgacgccgcccccuccaccgacggcgccgccggccucguccccgaguccaacaacgaggucauggcccucgagcccgucgccggcgucgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucgagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15812 - RNA, 1623 nt, Artificial Sequence
  derived and/or modified sequence opt2 from VP1__Norovirus_and/or_Norovirus-like__LC145792
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccaguggguccucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15813 - RNA, 1623 nt, Artificial Sequence
  derived and/or modified sequence opt2 from VP1__Norovirus_and/or_Norovirus-like__LC145797
augaagauggccuccaacgacgccgcccccuccaccgacggcgccgccggccucguccccgaguccaacaacgaggucauggcccucgagcccgucgccggcgucgcccucgccgcccccgucaccggccagaccaacaucaucgaccccuggauccgcgccaacuucguccccgcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcucuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacaucuccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15814 - RNA, 1623 nt, Artificial Sequence
  derived and/or modified sequence opt2 from VP1__Norovirus_and/or_Norovirus-like__LC145808
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacgcccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15815 - RNA, 1623 nt, Artificial Sequence
  derived and/or modified sequence opt2 from VP1__Norovirus_and/or_Norovirus-like__LC145801
augaagauggccuccaacgacgccgcccccuccaccgacggcgccgccggccucguccccgaguccaccaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcgcccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15816 - RNA, 1623 nt, Artificial Sequence
  derived and/or modified sequence opt2 from VP1__Norovirus_and/or_Norovirus-like__AB662884
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaacuucacccccgucggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15817 - RNA, 1623 nt, Artificial Sequence
  derived and/or modified sequence opt2 from VP1__Norovirus_and/or_Norovirus-like__LC145802
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggccacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgaguucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggccuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacgcccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucgaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15818 - RNA, 1623 nt, Artificial Sequence
  derived and/or modified sequence opt2 from VP1__Norovirus_and/or_Norovirus-like__AB662897
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaccuccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15819 - RNA, 1623 nt, Artificial Sequence
  derived and/or modified sequence opt2 from VP1__Norovirus_and/or_Norovirus-like__AB662899
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaacuucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15820 - RNA, 1623 nt, Artificial Sequence
  derived and/or modified sequence opt2 from VP1__Norovirus_and/or_Norovirus-like__AB662894
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgccaacuucacccccgucggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15821 - RNA, 1623 nt, Artificial Sequence
  derived and/or modified sequence opt2 from VP1__Norovirus_and/or_Norovirus-like__LC145803
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcuccuccuucgaccccuccgaggacauccccgccccccucggcauccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15822 - RNA, 1623 nt, Artificial Sequence
  derived and/or modified sequence opt2 from VP1__Norovirus_and/or_Norovirus-like__AB662889
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaaguccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaacuucacccccgucggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15823 - RNA, 1623 nt, Artificial Sequence
  derived and/or modified sequence opt2 from VP1__Norovirus_and/or_Norovirus-like__AB662876
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaacuucacccccgccggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcuga

SEQ ID NO: 15824 - RNA, 1620 nt, Artificial Sequence
  derived and/or modified sequence opt2 from VP1__Norovirus_and/or_Norovirus-like__KU555841
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcuccgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 15825 - RNA, 1620 nt, Artificial Sequence
  derived and/or modified sequence opt2 from VP1__Norovirus_and/or_Norovirus-like__GQ856468
augaagauggccuccaacgacgccgcccccuccaacgacggcgccaccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacaucgucguccagccccagaacggccgcugcacccucgacggcgagcuccagggcaccacccagcuccucaccaccgccaucugcuccuaccgcggcaugaccuccaaccccaccuccgacuacugggacgaccaccuccuccaccucguccaccccaacggcgccaccuacgaccccaccgaggacguccccgcccccuucggcacccaggacuuccgcggcauccucuacggcaugcucacccagaacccccgcaccuccggcgacgaggccgccaacucccacggcaucuacaucuccuccaccuccgagaaguucacccccaagcucggcaccaucggccuccaccagguccagggccgccacucccagcaccagcaguccaaguucacccccgucggcaucgccgucaacggcaacacccccuuccgccagugggagcuccccaacuacuccggcgcccucacccucaacaccaaccucgcccccgccgucggccccaacuuccccggcgagcagauccucuucuuccgcuccaacguccccuccguccagggcggccagcccaucgagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcguccaguga

SEQ ID NO: 15826 - RNA, 1620 nt, Artificial Sequence
  derived and/or modified sequence opt2 from VP1__Norovirus_and/or_Norovirus-like__AB684681
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccgccaaccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccgcccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgccgagaccgacaaccccgacaaguggcacaugcagcuccagaaccucaacggcaccaccuacgaccccaccgacgacguccccgccccccucggcacccccgacuuccgcggccuccucuucggcgucgccucccagcgcaacgucggcaacgacgcccccggcuccacccgcgcccacgaggucgucaucuccaccaccuccccccaguucguccccaagcucggcuccaucaacuuccgcuccaccuccgaggacuuccgcaccggccagcccacccgcuucacccccgucggcaucaacgacgaggacaaccaccccuucaaccagugggagcuccccgacuacuccggccgccucacccucaacaugaaccucgccccccccgucgcccccaacuuccccggcgagcagcuccucuucuuccgcuccaacguccccugcuccggcggcuacaaccagggcaucaucgacugccucaucccccaggaguggauccagcacuucuaccaggaguccgcccccucccaguccgaggucgcccucauccgcuacgucaaccccgacaccggccgcacccucuucgaggccaagcuccaccgcaccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15827 - RNA, 1620 nt, Artificial Sequence
  derived and/or modified sequence opt2 from VP1__Norovirus_and/or_Norovirus-like__AB809988
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgcuga

SEQ ID NO: 15828 - RNA, 1620 nt, Artificial Sequence
  derived and/or modified sequence opt2 from VP1__Norovirus_and/or_Norovirus-like__AB810011
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaaccgcggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgcuga

SEQ ID NO: 15829 - RNA, 1620 nt, Artificial Sequence
  derived and/or modified sequence opt2 from VP1__Norovirus_and/or_Norovirus-like__AB809994
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccagcgccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgcuga

SEQ ID NO: 15830 - RNA, 1620 nt, Artificial Sequence
  derived and/or modified sequence opt2 from VP1__Norovirus_and/or_Norovirus-like__KX767083
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccauccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucggcaccgacaccuccaacgacuucgaggccaaccagaacaccaaguucacccccgucggcgucauccaggacggcgacaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15831 - RNA, 1620 nt, Artificial Sequence
  derived and/or modified sequence opt2 from VP1__Norovirus_and/or_Norovirus-like__LN854565
augaagauggccuccaacgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccauccccauccucaccgucgaggagaugaccaacucccgcuuccccaucccccucgagaagcucuacaccggccccuccuccgccuucgucguccagccccagaacggccgcugcaccaccgacggcguccuccucggcaccacccagcucucccccgucaacaucugcaccuuccgcggcgacgucaccaacauccagggcucccacaccuacaccaugaaccucgccucccucaacuggaacaacuacgaccccaccgaggagacccccgccccccucggcacccccgacuucgucggcaagauccagggcguccucacccagaccaccaagggccagggcuccacccgcggccacaaggccaccgucuacaccggcuccgccuccuucacccccaagcucggcuccguccaguuccgcaccgacacccagaacgacuucgucacccaccagaacaccaaguucacccccgucggcgucauccaggacggcgacaccacccaccgcaacgagccccagcaguggguccuccccaacuacuccggcgucaacacccacaacguccaccucgcccccgccgucgcccccaccauccccggcgagcagcuccucuucuuccgcuccuccaugcccggcugcuccggcuaccccaacauggaccucgacugccucgucccccaggaguggguccagcacuucuaccaggaggccgcccccgcccucuccgacgucgcccuccuccgcuucgucaaccccgacaccggccgcguccucuucgagugcaagcuccacaaguccggcuacgucaccgucgcccacaccggccaccacgaccucgucaucccccccaacggcuacuuccgcuucgacuccugggucaaccaguucuacacccucgcccccaugggcaacggcaccggccgccgccgcgucuga

SEQ ID NO: 15832 - RNA, 1620 nt, Artificial Sequence
  derived and/or modified sequence opt2 from VP1__Norovirus_and/or_Norovirus-like__KX354071
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccagaacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15833 - RNA, 1620 nt, Artificial Sequence
  derived and/or modified sequence opt2 from VP1__Norovirus_and/or_Norovirus-like__AB933688
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccgcuucuccaccgacaccgagaacgacuucgagauccaccagaacaccaaguucacccccgucggcgucauccaggacggcuccaccacccaccgcaacgagccccagcaguggguccuccccuccuacuccggccgcgacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15834 - RNA, 1620 nt, Artificial Sequence
  derived and/or modified sequence opt2 from VP1__Norovirus_and/or_Norovirus-like__GQ845337
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucauccccuccaacggcuacuuccgcuucgacuccugggucaaccaguucuacacccucgcccccaugggcaacggcaccggccgccgccgcgucuga

SEQ ID NO: 15835 - RNA, 1620 nt, Artificial Sequence
  derived and/or modified sequence opt2 from VP1__Norovirus_and/or_Norovirus-like__JX155747
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15836 - RNA, 1620 nt, Artificial Sequence
  derived and/or modified sequence opt2 from VP1__Norovirus_and/or_Norovirus-like__JX155737
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15837 - RNA, 1620 nt, Artificial Sequence
  derived and/or modified sequence opt2 from VP1__Norovirus_and/or_Norovirus-like__KX354055
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15838 - RNA, 1620 nt, Artificial Sequence
  derived and/or modified sequence opt2 from VP1__Norovirus_and/or_Norovirus-like__KX353957
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuucaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15839 - RNA, 1620 nt, Artificial Sequence
  derived and/or modified sequence opt2 from VP1__Norovirus_and/or_Norovirus-like__KF509947
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcgccgacggcuccacccgcggccacaaggccaucgucuacaccggcuccgccgacuucgcccccaagcucggccgcguccaguucgagaccgacaccgaccacgacuucgaggccaaccagaacaccaaguucacccccgucggcgucacccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15840 - RNA, 1620 nt, Artificial Sequence
  derived and/or modified sequence opt2 from VP1__Norovirus_and/or_Norovirus-like__AB504326
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacacccgcuucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15841 - RNA, 1620 nt, Artificial Sequence
  derived and/or modified sequence opt2 from VP1__Norovirus_and/or_Norovirus-like__KX354056
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucggcaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcucggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15842 - RNA, 1620 nt, Artificial Sequence
  derived and/or modified sequence opt2 from VP1__Norovirus_and/or_Norovirus-like__AB541255
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacacccgcuucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15843 - RNA, 1620 nt, Artificial Sequence
  derived and/or modified sequence opt2 from VP1__Norovirus_and/or_Norovirus-like__KP784696
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcgagauccagggcguccucacccagaccacccgcaccgacggcuccacccgcggccacaaggccaccgucuacaccggcuccgccgacuucgcccccaagcucggccgcauccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccucccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15844 - RNA, 1620 nt, Artificial Sequence
  derived and/or modified sequence opt2 from VP1__Norovirus_and/or_Norovirus-like__KX354042
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccuccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15845 - RNA, 1620 nt, Artificial Sequence
  derived and/or modified sequence opt2 from VP1__Norovirus_and/or_Norovirus-like__KX354007
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagguccccgccccccucggcacccccgacuucgucggcaagauccagggcaugcucacccagaccacccgcaccgacggcuccacccgcggccacaaggccaccgucuacaccggcuccgccgacuucacccccaagcucggccgcauccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15846 - RNA, 1620 nt, Artificial Sequence
  derived and/or modified sequence opt2 from VP1__Norovirus_and/or_Norovirus-like__KT780393
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucacccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15847 - RNA, 1620 nt, Artificial Sequence
  derived and/or modified sequence opt2 from VP1__Norovirus_and/or_Norovirus-like__KX354043
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacaccuacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15848 - RNA, 1620 nt, Artificial Sequence
  derived and/or modified sequence opt2 from VP1__Norovirus_and/or_Norovirus-like__KX354008
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagguccccgccccccucggcacccccgacuucgucggcaagauccagggcaugcucacccagaccacccgcaccgacggcuccacccgcggccacaaggccaccgucuacaccggcuccgccgacuucacccccaagcucggccgcauccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcgucuga

SEQ ID NO: 15849 - RNA, 1620 nt, Artificial Sequence
  derived and/or modified sequence opt2 from VP1__Norovirus_and/or_Norovirus-like__KR904217
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcuccaccgacggcguccuccucggcaccacccagcucucccccgucaacaucugcaccuuccgcggcgacgucacccacaucgccggcucccacaacuacaccaugaaccucgccucccagaacugguccuccuacgaccccaccgaggagauccccgccccccucggcacccccgacuucgucggcaagauccagggcguccucacccagaccacccgcuccgacggcuccacccgcggccacaaggccaccgucuacaccggcuccgccgacuucucccccaagcucggccgcguccaguucgccaccgacaccgacaacgacuucgucuccaaccagaacaccaaguucacccccgucggcgucauccaggacggcgacaccgcccaccgcaacgagccccagcaguggguccuccccuccuacuccggccgcaacauccacaacguccaccucgcccccgccgucgcccccaccuuccccggcgagcagcuccucuucuuccgcuccaccauccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccacuucuacacccucgcccccaugggcaacggcaccggccgccgccgcgucuga

SEQ ID NO: 15850 - RNA, 1620 nt, Artificial Sequence
  derived and/or modified sequence opt2 from VP1__Norovirus_and/or_Norovirus-like__KJ685412
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgccaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15851 - RNA, 1620 nt, Artificial Sequence
  derived and/or modified sequence opt2 from VP1__Norovirus_and/or_Norovirus-like__KF008240
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggucaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15852 - RNA, 1620 nt, Artificial Sequence
  derived and/or modified sequence opt2 from VP1__Norovirus_and/or_Norovirus-like__KX354125
augaagauggccuccuccgacgccaaccccuccgacggcuccgccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccgacggcuccacccgcggccacaaggccaccgucuacaccggcuccgccgacuucucccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcgucuga

SEQ ID NO: 15853 - RNA, 1620 nt, Artificial Sequence
  derived and/or modified sequence opt2 from VP1__Norovirus_and/or_Norovirus-like__KX354094
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15854 - RNA, 1620 nt, Artificial Sequence
  derived and/or modified sequence opt2 from VP1__Norovirus_and/or_Norovirus-like__KX354058
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgaguucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15855 - RNA, 1620 nt, Artificial Sequence
  derived and/or modified sequence opt2 from VP1__Norovirus_and/or_Norovirus-like__KX354057
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgaguucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15856 - RNA, 1620 nt, Artificial Sequence
  derived and/or modified sequence opt2 from VP1__Norovirus_and/or_Norovirus-like__KX354034
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15857 - RNA, 1620 nt, Artificial Sequence
  derived and/or modified sequence opt2 from VP1__Norovirus_and/or_Norovirus-like__KX354027
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccgcaacuacaccaugaaccucgccucccagaacuggaacaacuacgaccccaccgaggagauccccgccccccucggcgcccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgucuga

SEQ ID NO: 15858 - RNA, 1620 nt, Artificial Sequence
  derived and/or modified sequence opt2 from VP1__Norovirus_and/or_Norovirus-like__KX354025
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15859 - RNA, 1620 nt, Artificial Sequence
  derived and/or modified sequence opt2 from VP1__Norovirus_and/or_Norovirus-like__KJ685406
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15860 - RNA, 1620 nt, Artificial Sequence
  derived and/or modified sequence opt2 from VP1__Norovirus_and/or_Norovirus-like__KF008241
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucuccaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15861 - RNA, 1620 nt, Artificial Sequence
  derived and/or modified sequence opt2 from VP1__Norovirus_and/or_Norovirus-like__AB504327
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcuccgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacacccgcuucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15862 - RNA, 1620 nt, Artificial Sequence
  derived and/or modified sequence opt2 from VP1__Norovirus_and/or_Norovirus-like__KY424329
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaacuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15863 - RNA, 1620 nt, Artificial Sequence
  derived and/or modified sequence opt2 from VP1__Norovirus_and/or_Norovirus-like__KT780389
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgcaagcgcgucuga

SEQ ID NO: 15864 - RNA, 1620 nt, Artificial Sequence
  derived and/or modified sequence opt2 from VP1__Norovirus_and/or_Norovirus-like__KX354134
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguucuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15865 - RNA, 1620 nt, Artificial Sequence
  derived and/or modified sequence opt2 from VP1__Norovirus_and/or_Norovirus-like__KX354126
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccgacggcuccacccgcggccacaaggccaccgucuacaccggcuccgccgacuucucccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcgucuga

SEQ ID NO: 15866 - RNA, 1620 nt, Artificial Sequence
  derived and/or modified sequence opt2 from VP1__Norovirus_and/or_Norovirus-like__KR904237
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcgacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcaucuga

SEQ ID NO: 15867 - RNA, 1620 nt, Artificial Sequence
  derived and/or modified sequence opt2 from VP1__Norovirus_and/or_Norovirus-like__KP241911
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15868 - RNA, 1620 nt, Artificial Sequence
  derived and/or modified sequence opt2 from VP1__Norovirus_and/or_Norovirus-like__KJ685411
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccucaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15869 - RNA, 1620 nt, Artificial Sequence
  derived and/or modified sequence opt2 from VP1__Norovirus_and/or_Norovirus-like__KF008242
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcgucuga

SEQ ID NO: 15870 - RNA, 1620 nt, Artificial Sequence
  derived and/or modified sequence opt2 from VP1__Norovirus_and/or_Norovirus-like__KF060112
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15871 - RNA, 1620 nt, Artificial Sequence
  derived and/or modified sequence opt2 from VP1__Norovirus_and/or_Norovirus-like__JX126912
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucauccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15872 - RNA, 1620 nt, Artificial Sequence
  derived and/or modified sequence opt2 from VP1__Norovirus_and/or_Norovirus-like__KX354143
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaucgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15873 - RNA, 1620 nt, Artificial Sequence
  derived and/or modified sequence opt2 from VP1__Norovirus_and/or_Norovirus-like__KU985164
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgucuga

SEQ ID NO: 15874 - RNA, 1620 nt, Artificial Sequence
  derived and/or modified sequence opt2 from VP1__Norovirus_and/or_Norovirus-like__KX950760
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagguccuccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccauccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccaacggcuccacccgcggccacaaggccaccgucuacaccggcuccgccgacuucgcccccaagcucggccgcguccaguucgagaccgacaccuccgacgacuucgagaccucccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaucaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15875 - RNA, 1620 nt, Artificial Sequence
  derived and/or modified sequence opt2 from VP1__Norovirus_and/or_Norovirus-like__KJ685402
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15876 - RNA, 1620 nt, Artificial Sequence
  derived and/or modified sequence opt2 from VP1__Norovirus_and/or_Norovirus-like__KF060140
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacauccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15877 - RNA, 1620 nt, Artificial Sequence
  derived and/or modified sequence opt2 from VP1__Norovirus_and/or_Norovirus-like__KX354132
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaccaccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguucuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15878 - RNA, 1620 nt, Artificial Sequence
  derived and/or modified sequence opt2 from VP1__Norovirus_and/or_Norovirus-like__KX354006
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagguccccgccccccucggcacccccgacuucgucggcaagauccagggcaugcucacccagaccacccgcaccgacggcuccacccgcggccacaaggccaccgucuacaccggcuccgccgacuucacccccaagcucggccgcauccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgccuccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcgucuga

SEQ ID NO: 15879 - RNA, 1620 nt, Artificial Sequence
  derived and/or modified sequence opt2 from VP1__Norovirus_and/or_Norovirus-like__KX354145
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15880 - RNA, 1620 nt, Artificial Sequence
  derived and/or modified sequence opt2 from VP1__Norovirus_and/or_Norovirus-like__KX354140
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucgccacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15881 - RNA, 1620 nt, Artificial Sequence
  derived and/or modified sequence opt2 from VP1__Norovirus_and/or_Norovirus-like__KX354119
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguucuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15882 - RNA, 1620 nt, Artificial Sequence
  derived and/or modified sequence opt2 from VP1__Norovirus_and/or_Norovirus-like__KX354018
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucggcgccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15883 - RNA, 1620 nt, Artificial Sequence
  derived and/or modified sequence opt2 from VP1__Norovirus_and/or_Norovirus-like__AB972499
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15884 - RNA, 1620 nt, Artificial Sequence
  derived and/or modified sequence opt2 from VP1__Norovirus_and/or_Norovirus-like__KF060142
augaagauggccuccuccgacgccaaccccuccgacggcuccgccgccaaccucguccccgaggucaacaacgaggucauggcccucgaccccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15885 - RNA, 1620 nt, Artificial Sequence
  derived and/or modified sequence opt2 from VP1__Norovirus_and/or_Norovirus-like__KF060138
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15886 - RNA, 1620 nt, Artificial Sequence
  derived and/or modified sequence opt2 from VP1__Norovirus_and/or_Norovirus-like__KP784697
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgacccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15887 - RNA, 1620 nt, Artificial Sequence
  derived and/or modified sequence opt2 from VP1__Norovirus_and/or_Norovirus-like__KF060111
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15888 - RNA, 1620 nt, Artificial Sequence
  derived and/or modified sequence opt2 from VP1__Norovirus_and/or_Norovirus-like__KF060089
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15889 - RNA, 1620 nt, Artificial Sequence
  derived and/or modified sequence opt2 from VP1__Norovirus_and/or_Norovirus-like__KP096333
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagacccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15890 - RNA, 1620 nt, Artificial Sequence
  derived and/or modified sequence opt2 from VP1__Norovirus_and/or_Norovirus-like__KF060153
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgaggucgaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15891 - RNA, 1620 nt, Artificial Sequence
  derived and/or modified sequence opt2 from VP1__Norovirus_and/or_Norovirus-like__KF060125
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgaggucgaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcacccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15892 - RNA, 1620 nt, Artificial Sequence
  derived and/or modified sequence opt2 from VP1__Norovirus_and/or_Norovirus-like__KX354135
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuuccucaaguccaccaugcccggcugcuccggcuaccccaacauggaccucgacugccuccucccccaggaguggguccaguucuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15893 - RNA, 1620 nt, Artificial Sequence
  derived and/or modified sequence opt2 from VP1__Norovirus_and/or_Norovirus-like__KX354045
augaagauggccuccuccgacgccaaccccuccgacggcuccgccgccaaccucguccccgacgucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15894 - RNA, 1620 nt, Artificial Sequence
  derived and/or modified sequence opt2 from VP1__Norovirus_and/or_Norovirus-like__LC153121
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15895 - RNA, 1620 nt, Artificial Sequence
  derived and/or modified sequence opt2 from VP1__Norovirus_and/or_Norovirus-like__KF668568
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccaucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcggcgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaucaccaaguucacccccaucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15896 - RNA, 1620 nt, Artificial Sequence
  derived and/or modified sequence opt2 from VP1__Norovirus_and/or_Norovirus-like__KF668567
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuccaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccaucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15897 - RNA, 1620 nt, Artificial Sequence
  derived and/or modified sequence opt2 from VP1__Norovirus_and/or_Norovirus-like__KR904210
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucgagacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacuccaaccagaacaccaaguucacccccgucggcgucauccaggacggcggcaccacccaccgcaacgagccccagcaguggguccuccccuccuacuccggccgcgacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15898 - RNA, 1620 nt, Artificial Sequence
  derived and/or modified sequence opt2 from VP1__Norovirus_and/or_Norovirus-like__JX459907
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgacgagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15899 - RNA, 1620 nt, Artificial Sequence
  derived and/or modified sequence opt2 from VP1__Norovirus_and/or_Norovirus-like__KF060062
augaagauggccuccuccgacgccaaccccaccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagacccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15900 - RNA, 1620 nt, Artificial Sequence
  derived and/or modified sequence opt2 from VP1__Norovirus_and/or_Norovirus-like__KF060080
augaagauggccuccuccgacgccaaccccuccgacggcuccgccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15901 - RNA, 1620 nt, Artificial Sequence
  derived and/or modified sequence opt2 from VP1__Norovirus_and/or_Norovirus-like__KF378731
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcacccuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggcuacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15902 - RNA, 1620 nt, Artificial Sequence
  derived and/or modified sequence opt2 from VP1__Norovirus_and/or_Norovirus-like__AB933731
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacuccaaggucucccccaucccccucaagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15903 - RNA, 1620 nt, Artificial Sequence
  derived and/or modified sequence opt2 from VP1__Norovirus_and/or_Norovirus-like__AB933749
augaagauggccuccaacgacgucaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccgucguccgcaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15904 - RNA, 1620 nt, Artificial Sequence
  derived and/or modified sequence opt2 from VP1__Norovirus_and/or_Norovirus-like__KC517370
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccguccccuccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacacccuccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccauguacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgccccaccaugcccggcugcuccggcuaccccaacauggaccucgaccgccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuga

SEQ ID NO: 15905 - RNA, 1620 nt, Artificial Sequence
  derived and/or modified sequence opt2 from VP1__Norovirus_and/or_Norovirus-like__EF547396
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgaggucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcaacggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgacaccgacuacucccccaacaccuccaucaucugcacccucgacuggcucucccagaccaccggccaguccaacgucgaccccuggcagauccccaccuacggcuccacccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgucgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucuga

SEQ ID NO: 15906 - RNA, 1620 nt, Artificial Sequence
  derived and/or modified sequence opt2 from VP1__Norovirus_and/or_Norovirus-like__JN699047
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgagaucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcaacggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgaccacgacuacgaccccaacaccuccaucaucugcacccucgacuggcucucccagaccaccggccagaacaacgucgaccccuggcagauccccaccuacggcuccacccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgucgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucuga

SEQ ID NO: 15907 - RNA, 1620 nt, Artificial Sequence
  derived and/or modified sequence opt2 from VP1__Norovirus_and/or_Norovirus-like__KT781411
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccucccagaacaucuccaucgcccaggccaccauguucccccacgucaucgccgacguccgcguccucgagcccaucgaggucccccucgaggacguccgcaacguccucuuccacaacaacgacaacucccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaacgccaugaugaucucccgcgaccacggccagaugguccaguuccagaacggccgcgucacccucgacggccagcuccagggcaccacccccaccucccucucccagcucugcaagauccgcggcaaggucuuccucgccuccggcggcaacggccucaaccucaccgagcucgacggcuccgccuaccacgccuucgagucccccgcccccaucggcuuccccgacaucggcgacugcgacuggcacaugaacgccaccgccaccuccaacuucaccggcuccaacgacgagcaccagauccucgucaagcaggaguccaccuucgccccccaccucggccacguccaggccgaccaccuccccgaggucgccaacaccgaccucauggucucccucuccuggaucucccccgucuccgaccagcaccgccgcgacgucgaccccugggucaucccccgcuacggcuccacccucaccgaggccgcccagcucgccccccccaucuacccccccggcuucggcgaggccaucgucuucuucauguccgacuuccccgucgucuccggcgucaacggcaugcgcauccccugcacccucccccaggaguacgucgcccacuucgucaacgagcaggcccccacccgcggcgaggccgcccuccuccacuacgucgaccccgacacccaccgcaaccucggcgaguucaagaucuaccccgagggcuucaugaccugcguccccaacuccuccggcaccggcccccagacccuccccaucaacggcgucuucaccuucgucuccugggucucccgcuucuaccagcucaagcccgucggcaccgccggccccgcccgccgccucuga

SEQ ID NO: 15908 - RNA, 1620 nt, Artificial Sequence
  derived and/or modified sequence opt2 from VP1__Norovirus_and/or_Norovirus-like__U04469
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucauguccaacuacguccaggccccccagggcgaguucaccaucucccccaacaacacccccggcgacauccucuucgaccuccagcucggcccccaccucaaccccuuccucucccaccucgcccagauguacaacggcugggucggcaacaugcgcgucaagguccuccucgccggcaacgccuucaccgccggcaagaucaucaucuccugcaucccccccggcuucgccgcccagaacaucuccaucgcccaggccaccauguucccccacgucaucgccgacguccgcguccucgagcccaucgaggucccccucgaggacguccgcaacguccucuuccacaacaacgacuccucccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaacgccaugaugaucucccgcgaccacggccagaugguccaguuccagaacggccgcgucacccucgacggccagcuccagggcaccacccccaccucccucucccagcucugcaagauccgcggcaaggucuuccacgccuccggcggcaacggccucaaccucaccgagcucgacggcuccgccuaccacgccuucgagucccccgcccccaucggcuuccccgacaucggcgacugcgacuggcacauguccgccaccgccaccaacaacuucaccggcuccuccaacgaguaccagauccucaucaagcaggaguccgccuucgccccccaccucggccacguccaggccgacaaccucuccgccggcgccaacaccgaccucaucgucucccucuccuggaucucccccgucuccgaccagcaccgccacgacgucgaccccugggucaucccccgcuacggcuccucccucaccgaggccgcccagcucgccccccccaucuacccccccggcuucggcgaggccaucgucuucuucauguccgacuuccccgucgucuccggcgucaacggcaugcgcauccccugcacccucccccaggaguacgucgcccacuucgucaacgagcaggcccccacccgcggcgaggccgcccuccuccacuacgucgaccccgacacccaccgcaaccucggcgaguucaagauguaccccgagggcuucaugaccugcguccccaacuccuccggcuccggcccccagacccuccccaucaacggcgucuucaccuucgucuccugggucucccgcuucuaccagcucaagcccgucggcaccgccggccccgcccgccgccucuga

SEQ ID NO: 15909 - RNA, 1620 nt, Artificial Sequence
  derived and/or modified sequence opt2 from VP1__Norovirus_and/or_Norovirus-like__JN699049
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccucccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacguccucuccaacucccgcguccccucccucaucaaguucaugauggucucccaggaccacggccagaugguccaguuccagaacggccgcgucacccucgacggccagcuccagggcaccacccccaccuccgccucccagcucugcaagaugcgcggcaccgucuaccacgccuccggcggccagggccucaaccucaccgagaucgacggcacccccuaccacgccuucgagucccccgcccccaucggcuuccccgaccucggcgacuccgacuggcacaucaacgccucccccgccaccaccuucaacaccggcgaguccgucaagcgccucgacauggagcagggcuccuccuucgccccccaccucggcaccguccacuacaccaacgccgacuacgacgccaacaccgaccucaucugcucccucgaguggcucuccccccccuccggcggcacccccaacaaggucaaccccugggccaucccccgcuacggcuccacccucaccgaggccgcccagcucgccccccccaucuacccccccggcuucggcgaggccaucgucuucuucauguccgacuuccccaucgccaacggccaggacggccucaagguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucgucuccugggucucccgcuucuaccagcucaagcccgucggcaccaccggccccguccgccgccucuga

SEQ ID NO: 15910 - RNA, 1620 nt, Artificial Sequence
  derived and/or modified sequence opt2 from VP1__Norovirus_and/or_Norovirus-like__GQ856473
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacaucuccaucgcccaggccaccauguucccccacgucaucgccgacguccgcguccucgagcccaucgaggucccccucgaggacguccgcaacguccucuuccacaacaacgacaacucccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaacgccaugaugaucucccgcgaccacggccagaugguccaguuccagaacggccgcgucacccucgacggccagcuccagggcaccacccccaccucccucucccagcucugcaagauccgcggcaaggucuuccacgccuccggcggcaacggccucaaccucaccgagcucgacggcuccgccuaccacgccuucgagucccccgcccccaucggcuuccccgacaucggcgagugcgacuggcacaugaacgccaccgccaccuccaacuucaccggcuccaacgacgaguaccagauccucgucaagcaggaguccaccuucgccccccaccucggccacguccaggccgacucccucuccgccgacgccaacaccgaccucauggucucccucuccuggaucucccccgucuccgaccagcaccgccgcgacgucgaccccugggucaucccccgcuacggcuccucccucaccgaggccgcccagcucgccccccccaucuacccccccggcuucggcgaggccaucgucuucuucauguccgacuuccccgucgucuccggcgucaacggcaugcgcauccccugcacccucccccaggaguacgucgcccacuucgucaacgagcaggcccccacccgcggcgaggccgcccuccuccacuacgucgaccccgacacccaccgcaaccucggcgaguucaagauguaccccgagggcuucaugaccugcguccccaacuccuccggcuccggcccccagacccuccccaucaacggcguccucaccuucgucuccugggucucccgcuucuaccagcucaagcccgucggcaccgccggccccgcccgccgccucuga

SEQ ID NO: 15911 - RNA, 1620 nt, Artificial Sequence
  derived and/or modified sequence opt2 from VP1__Norovirus_and/or_Norovirus-like__JN699050
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccucccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacguccucuccaacucccgcguccccucccucaucaaguccaugauggucucccaggaccacggccagaugguccaguuccagaacggccgcgucacccucgacggccagcuccagggcaccacccccaccuccgccucccagcucugcaagaugcgcggcaccgucuaccacgccuccggcggccagggccucaaccucaccgagaucgacggcacccccuaccacgccuucgagucccccgcccccaucggcuuccccgacaucggcgacuccgacuggcacaucaacgccucccccgccaccaccuucgacuccggcgaguccaucaagcgccucgacauggagcagggcuccuccuucgccccccaccucggcaccguccacuacaccaacgccgacuaccccgccaacaccgaccucaucugcucccucgaguggcucuccccccccuccggcggcacccccaacaaggucaaccccuggaccaucccccgcuacggcuccacccucaccgaggccgcccagcucgccccccccaucuacccccccggcuucggcgaggccaucgucuucuucauguccgacuuccccaucgccaacggccaggacggccucaagguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucgucuccugggucucccgcuucuaccagcucaagcccgucggcaccaccggccccguccgccgccucuga

SEQ ID NO: 15912 - RNA, 1620 nt, Artificial Sequence
  derived and/or modified sequence opt2 from VP1__Norovirus_and/or_Norovirus-like__GQ856472
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgagaucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcuccggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgacaccgacuacaaccccaacaccuccaucaucugcacccucgacuggcucucccagaccaccggccaguccaacgucgaccccuggcagauccccaccuacggcuccgcccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgucgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucuga

SEQ ID NO: 15913 - RNA, 1620 nt, Artificial Sequence
  derived and/or modified sequence opt2 from VP1__Norovirus_and/or_Norovirus-like__GQ856471
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgagaucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcuccggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgacaccgacuacaaccccaacaccuccaucaucugcacccucgacuggcucucccagaccaccggccaguccaacgucgaccccuggcagauccccaccuacggcuccacccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgccgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucuga

SEQ ID NO: 15914 - RNA, 1620 nt, Artificial Sequence
  derived and/or modified sequence opt2 from VP1__Norovirus_and/or_Norovirus-like__JQ911594
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgagaucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcaacggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgacaccgacuacaaccccaacaccuccaucaucugcacccucgacuggcucucccagaccgccggccaguccaacgucgaccccuggcagauccccaccuacggcuccacccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgucgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucuga

SEQ ID NO: 15915 - RNA, 1620 nt, Artificial Sequence
  derived and/or modified sequence opt2 from VP1__Norovirus_and/or_Norovirus-like__GU296356
augaugauggccuccaaggacgccaccuccaacauggacggcaccuccggcgccggccagcucguccccgagaacaacaacaccuccgagcccaucaacauggagcccgucgccggcgccgucaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucgcccaccucucccagauguacaacggcugggucggcaacaugaagguccgcgucguccucgccggcaacgccuucuccgccggcaagaucaucgucugcugcaucccccccggcuucuccgcccccaacaucuccaucgcccaggccaccauguucccccacgucaucgccgacguccgcguccucgagcccaucgacaucccccucgacgacguccgcaacguccucuuccacaccaacgacaacggcaaccagaccaugcgccuccucugcaugcucuacaccccccuccgcuccggcggcaccuccuccggcaccgaccccuucgucaucgccggccgcguccucaccugccccacccccgacuucaacuuccucuuccucgucccccccaccgucgagcagaagaccaagcaguucuccguccccaaccucccccucaacgucauguccaacucccgcguccccucccuccucaacgccauggucgucucccccgaccaggcccaggucguccaguuccagaacggccgcugcacccucgacggccagaugcucggcaccaccaccgucuccgccuccugcgucgcccgcuuccgcggcaagaccuuccaggcccccgacgaccgccucggcaucaaccucgccgagaucuccggcgagcccuaccacgccuucgagucccccgccccccucggcuuccccgacuucggcgacggcgacuggcacgucaccgccaccaaggucgcccccucccagcucgaggccaacgaccccgucgucgucggcaacguccagcccuacaacccccaguucgccccccaccucggcacccucgucgucgagaaccccacccccaaccaggucgccaccggcaccgaccuccucuucaacaucaccuggcucuccaaccgcgccaacaaccgcuucaaccccuggaucauccccaacuacggcuccacccucaccgaggccgcccagcucgcccccuccaucuucccccccggcuucggcgagaccaucgucuacuucaacuccaccuuccccgccgucggcgccaccacccacgccgccauccccugccuccucccccaggaguucgucgcccacuucgucaacgagcaggcccccauccgcggcgaggccgcccuccuccacuacaucgaccccgacacccaccgcaaccucggcgaguucaagaucuaccccgagggcuucgucaccugcguccccaacgucggcggcaccggcccccagucccuccccaccaacggcaucuucgucuucgucuccugggucucccgcuacuaccagcucaagcccgucggcaccgccuga

SEQ ID NO: 15916 - RNA, 1620 nt, Artificial Sequence
  derived and/or modified sequence opt2 from VP1__Norovirus_and/or_Norovirus-like__KM461693
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaacgcccgcgccgccgaccucaccgacuccccccagcgcgcccgcaaccacccccuccacguccaggucaagaaccucgacggcacccaguacgaccccaccgacgacauccccgccguccucggcgccaucgacuucaagggcaccgucuucggcgucgccucccagcgcgacgucuccggcacccaggagcagggccacuacgccacccgcgcccacgaggcccacaucgacaccaccgaccccaaguacgcccccaagcucggcaccauccucaucaaguccgaguccaccgacuucaccaccaaccagcccauccgcuucacccccgucggcaugggcgacaacaacuggcgccagugggagcuccccgacuacuccggcucccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaugggcgucccccccaacggcuacuuccgcuucgaggccugggucaaccaguucuacacccucgcccccuga

SEQ ID NO: 15917 - RNA, 1620 nt, Artificial Sequence
  derived and/or modified sequence opt2 from VP1__Norovirus_and/or_Norovirus-like__LC145789
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgcuga

SEQ ID NO: 15918 - RNA, 1617 nt, Artificial Sequence
  derived and/or modified sequence opt2 from VP1__Norovirus_and/or_Norovirus-like__KX171417
augaagauggccuccaacgacgccgcccccuccaacgacggcgccgccggccucguccccgagggcaacaacgagacccucucccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccaagaccgaccacuccgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccggcuccacccgcgcccacgaggccgucaucuccaccuacuccccccaguucguccccaagcucggcuccgucaacuuccgcuccaacgacgacgacuuccagcuccagcccaccaaguucacccccgucugcaucaacgacgacgacgaccaccccuuccgccagugggagcuccccgacuacuccggccuccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgaggucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15919 - RNA, 1617 nt, Artificial Sequence
  derived and/or modified sequence opt2 from VP1__Norovirus_and/or_Norovirus-like__KX171412
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccgagaccgaccaccacgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccggcuccacccgcgcccacgaggccgucaucuccaccuacuccccccaguucguccccaagcucggcuccgucaacuuccgcuccaacgacgacgacuuccagcuccagcccaccaaguucacccccgucggcaucaacgacgacggcgaccaccccuuccgccagugggagcuccccgacuacuccggccuccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15920 - RNA, 1617 nt, Artificial Sequence
  derived and/or modified sequence opt2 from VP1__Norovirus_and/or_Norovirus-like__KU557839
augaagauggccuccaacgacgccgcccccuccuccgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccgagaccgaccaccgcgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccggcuccacccgcgcccacgaggccgucaucuccaccuacuccccccaguucguccccaagcucggcuccgucaacuuccgcuccaacgacaacgacuuccagcuccagcccaccaaguucacccccgucggcaucaacgacgacggcgaccaccccuuccgccagugggagcuccccgacuacuccggccuccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15921 - RNA, 1617 nt, Artificial Sequence
  derived and/or modified sequence opt2 from VP1__Norovirus_and/or_Norovirus-like__KP902564
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccgagaccgaccaccgcgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccgacuccacccgcgcccacgaggccgucaucuccaccuacuccccccaguucguccccaagcucggcuccgucaacuuccgcuccaacgacaacgacuuccagcuccagcccaccaaguucacccccgucggcaucaacgacgacggcgaccaccccuuccgccagugggagcuccccgacuacuccggccuccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15922 - RNA, 1617 nt, Artificial Sequence
  derived and/or modified sequence opt2 from VP1__Norovirus_and/or_Norovirus-like__KU587625
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccacaucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccgagaccgacaaccccgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccggcuccacccgcgcccacgaggccgucaucuccaccuacucccccaaguucguccccaagcucggcuccgucaacuuccgcuccaacgacgacgacuuccagcuccagcccacccgcuucacccccgucggcaucaacgacgacggcaaccaccccuuccgccagugggagcuccccgacuacuccggcguccucacccucaacaugaaccucgccccccccgucgcccccaacuuccccggcgagcagcuccuccucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15923 - RNA, 1617 nt, Artificial Sequence
  derived and/or modified sequence opt2 from VP1__Norovirus_and/or_Norovirus-like__KX171413
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccaccgagaccgaccaccgcgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccggcuccacccgcgcccacgaggccgucaucuccaccuacuccccccaguucguccccaagcucggcuccgucaacuuccgcuccaacgacgacgacuuccagcuccagcccaccaaguucacccccgucggcaucaacgacgacggcgaccaccccuuccgccagugggagcuccccgacuacuccggcccccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15924 - RNA, 1617 nt, Artificial Sequence
  derived and/or modified sequence opt2 from VP1__Norovirus_and/or_Norovirus-like__KP902565
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacaaccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccgagaccgaccaccgcgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccggcuccacccgcgcccacgaggccgucaucuccaccuacuccccccaguucguccccaagcucggcuccgucaacuuccgcuccaacgacaacgacuuccagcuccagcccaccaaguucacccccgucggcaucaacgacgacggcgaccaccccuuccgccagugggagcuccccgacuacuccggccuccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15925 - RNA, 1617 nt, Artificial Sequence
  derived and/or modified sequence opt2 from VP1__Norovirus_and/or_Norovirus-like__KX171416
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacaaccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccgagaccgaccaccgcgacaaguggcacaugcagcuccagaaccucaacggcaccaccuacgaccccaccgacgacguccccgccccccucggcacccccgacuucaagggcgucgucuucggcaucgccucccagcgcaacgucggcaacgacgcccccggcuccacccgcgcccacgaggccgucaucuccaccuacuccccccaguucguccccaagcucggcuccgucaacuuccgcuccaacgacaacgacuuccagcuccagcccaccaaguucacccccgucggcaucaacgacgacggcgaccaccccuuccgccagugggagcuccccgacuacuccggccuccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15926 - RNA, 1617 nt, Artificial Sequence
  derived and/or modified sequence opt2 from VP1__Norovirus_and/or_Norovirus-like__KU561250
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccgagaccgaccaccgcgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccggcuccacccgcgcccacgaggccgccaucuccaccuacuccccccaguucguccccaagcucggcuccgucaacuuccgcuccaacgacaacgacuuccagcuccagcccaccaaguucacccccgucggcaucaacgacgacggcgaccaccccuuccgccagugggagcuccccgacuacuccggccuccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 15927 - RNA, 1617 nt, Artificial Sequence
  derived and/or modified sequence opt2 from VP1__Norovirus_and/or_Norovirus-like__KU561251
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccacaacaacguccuccagguccagugccagaacggccgcugcacccucgacggcgagcuccagggcaccacccagcuccuccccuccggcaucugcgccuuccgcggccgcgucaccgccgagaccgaccaccgcgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccggcuccacccgcgcccacgaggccgucaucuccaccuacuccccccaguucguccccaagcucggcuccgucaacuuccgcuccaacgacaacgacuuccagcuccagcccaccaaguucacccccgucggcaucaacgacgacggcgaccaccccuuccgccagugggagcuccccgacuacuccggccuccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgcaccgcccaguga

SEQ ID NO: 15928 - RNA, 1617 nt, Artificial Sequence
  derived and/or modified sequence opt2 from VP1__Norovirus_and/or_Norovirus-like__AB810014
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuuccgcggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgcuga

SEQ ID NO: 15929 - RNA, 1617 nt, Artificial Sequence
  derived and/or modified sequence opt2 from VP1__Norovirus_and/or_Norovirus-like__AB809985
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgcuga

SEQ ID NO: 15930 - RNA, 1617 nt, Artificial Sequence
  derived and/or modified sequence opt2 from VP1__Norovirus_and/or_Norovirus-like__AB810003
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaaccgcggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugguucaaccaguucuacucccucgcccccaugggcaccggcaacggccgcuga

SEQ ID NO: 15931 - RNA, 1617 nt, Artificial Sequence
  derived and/or modified sequence opt2 from VP1__Norovirus_and/or_Norovirus-like__AB809975
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucuccuaccccuccggcgccuccuacgaccccaccgacgagguccccgccccccucggcacccaggacuucuccggcauccucuacggcguccucacccaggacaacgucuccgagcgcaccggcgaggccaagaacgccaagggcaucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgcuga

SEQ ID NO: 15932 - RNA, 1617 nt, Artificial Sequence
  derived and/or modified sequence opt2 from VP1__Norovirus_and/or_Norovirus-like__JX401280
augaagauggccuccuccgacgccaaccccuccgacggcuccuccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucucccccgaccucaaccccuaccucucccaccucucccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggccaacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagcgccucuucaccggccccuccaccgccuucgucguccagccccagaacggccgcugcaccaccgacggcguccuccucggcaccacccagcucuccgccgucaacaucugcaacuuccgcggcgaggucaaccacaucgccggcacccacgacuacaccaugcgccucaccucccagaacuggaacaacuacgaccccaccgaggagauccccgccccccucggcacccccgacuucgucggccgcauccagggcguccucacccagaccacccgcuccgacggcuccacccgcucccacaaggccaccgucuccaccggcuccguccacuucacccccaagcucggcuccguccaguucaccaccgacaccaccaacgaccucaacgccggccagaacaccaaguucacccccgucggcgucgagcagaccuccggcgaccaccaguccgagccccagcaguggacccuccccaacuacuccggcacccccaaccacaacguccaccucgcccccgccgucgcccccaccuuccccggcgagcagcuccucuucuuccgcuccacccuccccggcugcggcggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccaccgcuccggcuucaucaccgucgcccacuccggcucccacgaccucgucaucccccccaacggcuacuuccgcuucgacuccugggucaaccaguucuacacccucgcccccaugggcaacggcuccggccgccgccgcgucuga

SEQ ID NO: 15933 - RNA, 1617 nt, Artificial Sequence
  derived and/or modified sequence opt2 from VP1__Norovirus_and/or_Norovirus-like__KC962462
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagucccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaucgacggcguccuccucggcaccacccagcucucccccgucaacaucugcaccuuccgcggcgacgucacccacaucgccggcacccacaacuacaccaugaaccucgccacccagaacuggaacuccuacgaccccaccgaggagauccccgccccccucggcacccccgacuucgucggcaagauccagggcguccucacccagaccaccaagaccgacggcuccacccgcggccacaaggccaccgucugcaucggcuccgccgacuucgcccccaagcucggccgcguccaguucgagaccgacaccaacaacgaccucgagaccaaccagaacaccaaguucacccccgucggcgucauccagaacggcgagaccgcccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggcucccacgaccucgucaucccccccaacggcuacuuccgcuucgacuccugggucaaccaguucuacacccucgcccccaugggcaacggcaccggccgccgccgcuga

SEQ ID NO: 15934 - RNA, 1617 nt, Artificial Sequence
  derived and/or modified sequence opt2 from VP1__Norovirus_and/or_Norovirus-like__KX353974
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagauccaccagaacacccgcuucacccccgucggcgucauccaggacggcuccaccacccaccgcaacgagccccagcaguggguccuccccuccuacuccggccgcuccguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15935 - RNA, 1617 nt, Artificial Sequence
  derived and/or modified sequence opt2 from VP1__Norovirus_and/or_Norovirus-like__KF060122
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccaacggcuccacccgcggccacaaggccaccgucuacaccggcuccgccgacuucgcccccaagcucggccgcguccaguucgccaccgacaccaacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15936 - RNA, 1617 nt, Artificial Sequence
  derived and/or modified sequence opt2 from VP1__Norovirus_and/or_Norovirus-like__KR904234
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacuccgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcuccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccaccgcgccaccgucuacaccggcuccgccgacuucucccccaagcucggccgcguccaguucgccaccgacaccgacaacgacuucgucgccaaccagaacaccaaguucacccccgucggcgucauccaggacggcgacaccgcccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15937 - RNA, 1617 nt, Artificial Sequence
  derived and/or modified sequence opt2 from VP1__Norovirus_and/or_Norovirus-like__KR131769
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccaucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15938 - RNA, 1617 nt, Artificial Sequence
  derived and/or modified sequence opt2 from VP1__Norovirus_and/or_Norovirus-like__KR131764
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccuccucccgcaacuacaccaugaaccucgccucccagaacuggaacaacuacgaccccaccgaggagauccccgccccccucggcacccccgacuucgucggcaagauccagggcaugcucacccagaccaccaaguccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15939 - RNA, 1617 nt, Artificial Sequence
  derived and/or modified sequence opt2 from VP1__Norovirus_and/or_Norovirus-like__GU390901
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15940 - RNA, 1617 nt, Artificial Sequence
  derived and/or modified sequence opt2 from VP1__Norovirus_and/or_Norovirus-like__EU078408
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcacccgccccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucucccagaccacccgcggcgacggcuccacccgcggccacaaggccaccgucuccaccggcuccguccacuucacccccaagcucggcuccguccaguucaccaccgacaccaacaacgaccucgagaccggccagaacaccaaguucacccccgucggcgucguccaggacggcaacuccacccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 15941 - RNA, 1617 nt, Artificial Sequence
  derived and/or modified sequence opt2 from VP1__Norovirus_and/or_Norovirus-like__AB933676
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucuccaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccgcccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15942 - RNA, 1617 nt, Artificial Sequence
  derived and/or modified sequence opt2 from VP1__Norovirus_and/or_Norovirus-like__KX354082
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagcgcgacggcuccacccgcggccacaaggccaccgucuacaccggcuccgccgacuucacccccaagcucggcuccguccaguucggcaccgacaccgagaacgacuucgagacccaccagaacacccgcuucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15943 - RNA, 1617 nt, Artificial Sequence
  derived and/or modified sequence opt2 from VP1__Norovirus_and/or_Norovirus-like__KJ407076
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgucuga

SEQ ID NO: 15944 - RNA, 1617 nt, Artificial Sequence
  derived and/or modified sequence opt2 from VP1__Norovirus_and/or_Norovirus-like__JX459636
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15945 - RNA, 1617 nt, Artificial Sequence
  derived and/or modified sequence opt2 from VP1__Norovirus_and/or_Norovirus-like__JX445161
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15946 - RNA, 1617 nt, Artificial Sequence
  derived and/or modified sequence opt2 from VP1__Norovirus_and/or_Norovirus-like__EU876888
augaagauggccuccuccgacgccucccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcggcgacggcuccacccgcggccacaaggccaccgucuacaccggcuccgccgacuucgcccccaagcucggccgcguccaguucgccaccgacaccgacaacgacuucgaguccaaccagaacaccaaguucacccccgucggcgucauccaggacggcaacaccacccaccgcaacgagccccagcaguggguccuccccggcuacuccggccgcgacggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgaggucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 15947 - RNA, 1617 nt, Artificial Sequence
  derived and/or modified sequence opt2 from VP1__Norovirus_and/or_Norovirus-like__EU839584
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccaccaagcgcgacggcuccacccgcggccacaaggccaccgucuccaccggcuccguccacuucacccccaagcucggcuccguccaguucuccaccgacaccuccaacgacuucgagaucggccagaacacccgcuucacccccgucggcgucguccaggacggcuccaccacccaccagaacgagccccagcaguggguccuccccaacuacuccggccgcgacggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcgcccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 15948 - RNA, 1617 nt, Artificial Sequence
  derived and/or modified sequence opt2 from VP1__Norovirus_and/or_Norovirus-like__KX354090
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacacccgcuucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15949 - RNA, 1617 nt, Artificial Sequence
  derived and/or modified sequence opt2 from VP1__Norovirus_and/or_Norovirus-like__KF060124
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccaacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15950 - RNA, 1617 nt, Artificial Sequence
  derived and/or modified sequence opt2 from VP1__Norovirus_and/or_Norovirus-like__JX439826
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15951 - RNA, 1617 nt, Artificial Sequence
  derived and/or modified sequence opt2 from VP1__Norovirus_and/or_Norovirus-like__JX439815
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15952 - RNA, 1617 nt, Artificial Sequence
  derived and/or modified sequence opt2 from VP1__Norovirus_and/or_Norovirus-like__KC576912
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaugauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgacaacgacuucgagacccaccagaacacccgcuucacccccgucggcgucauccaggacggcgccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15953 - RNA, 1617 nt, Artificial Sequence
  derived and/or modified sequence opt2 from VP1__Norovirus_and/or_Norovirus-like__GQ845368
augaagauggccuccuccgacgccucccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcggcgacggcuccacccgcggccacaaggccaccgucuacaccggcuccgccgacuucgcccccaagcucggccgcguccaguucgccaccgacaccgacaacgacuucgaguccaaccagaacaccaaguucacccccgucggcgucauccaggacggcaacaccacccaccagaacgagccccagcaguggguccuccccggcuacuccggccgcgacggccacaacguccaccucgcccccgccgucgcccccaccuaccccggcgagcagcuccucuucuuccgcuccaccaugcccggcugcuccggcuaccccaacaugaaccucgacugccuccucccccaggaguggguccagcacuucuaccaggaggccgcccccgcccaguccgaggucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 15954 - RNA, 1617 nt, Artificial Sequence
  derived and/or modified sequence opt2 from VP1__Norovirus_and/or_Norovirus-like__AB541249
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15955 - RNA, 1617 nt, Artificial Sequence
  derived and/or modified sequence opt2 from VP1__Norovirus_and/or_Norovirus-like__EU078412
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucaccaccgacaccaacaacgaccucgagaccggccagaacacccgcuucacccccgucggcgucguccaggacggcaacuccacccaccagaacgagccccagcaguggguccuccccaacuacuccggccgcgccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 15956 - RNA, 1617 nt, Artificial Sequence
  derived and/or modified sequence opt2 from VP1__Norovirus_and/or_Norovirus-like__AB445395
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15957 - RNA, 1617 nt, Artificial Sequence
  derived and/or modified sequence opt2 from VP1__Norovirus_and/or_Norovirus-like__AB933655
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15958 - RNA, 1617 nt, Artificial Sequence
  derived and/or modified sequence opt2 from VP1__Norovirus_and/or_Norovirus-like__KM245072
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15959 - RNA, 1617 nt, Artificial Sequence
  derived and/or modified sequence opt2 from VP1__Norovirus_and/or_Norovirus-like__AB541282
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15960 - RNA, 1617 nt, Artificial Sequence
  derived and/or modified sequence opt2 from VP1__Norovirus_and/or_Norovirus-like__AB541202
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15961 - RNA, 1617 nt, Artificial Sequence
  derived and/or modified sequence opt2 from VP1__Norovirus_and/or_Norovirus-like__FJ514242
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15962 - RNA, 1617 nt, Artificial Sequence
  derived and/or modified sequence opt2 from VP1__Norovirus_and/or_Norovirus-like__KX353976
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacauccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgacaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15963 - RNA, 1617 nt, Artificial Sequence
  derived and/or modified sequence opt2 from VP1__Norovirus_and/or_Norovirus-like__KX353952
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacgucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacacccgcuucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15964 - RNA, 1617 nt, Artificial Sequence
  derived and/or modified sequence opt2 from VP1__Norovirus_and/or_Norovirus-like__KR131771
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15965 - RNA, 1617 nt, Artificial Sequence
  derived and/or modified sequence opt2 from VP1__Norovirus_and/or_Norovirus-like__AB933729
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaucgucuacaccggcuccgccgacuucgcccccaagcucggccgcguccaguucgccaccgacaccgacaacgacuucggcgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15966 - RNA, 1617 nt, Artificial Sequence
  derived and/or modified sequence opt2 from VP1__Norovirus_and/or_Norovirus-like__AB933646
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgaggucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15967 - RNA, 1617 nt, Artificial Sequence
  derived and/or modified sequence opt2 from VP1__Norovirus_and/or_Norovirus-like__JX155742
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15968 - RNA, 1617 nt, Artificial Sequence
  derived and/or modified sequence opt2 from VP1__Norovirus_and/or_Norovirus-like__JN400614
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccuccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15969 - RNA, 1617 nt, Artificial Sequence
  derived and/or modified sequence opt2 from VP1__Norovirus_and/or_Norovirus-like__JN400601
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcaacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15970 - RNA, 1617 nt, Artificial Sequence
  derived and/or modified sequence opt2 from VP1__Norovirus_and/or_Norovirus-like__JQ613538
augaagauggccuccuccgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcauccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccacccuccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15971 - RNA, 1617 nt, Artificial Sequence
  derived and/or modified sequence opt2 from VP1__Norovirus_and/or_Norovirus-like__HM802543
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcgacaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 15972 - RNA, 1617 nt, Artificial Sequence
  derived and/or modified sequence opt2 from VP1__Norovirus_and/or_Norovirus-like__AB541337
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15973 - RNA, 1617 nt, Artificial Sequence
  derived and/or modified sequence opt2 from VP1__Norovirus_and/or_Norovirus-like__AB541252
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15974 - RNA, 1617 nt, Artificial Sequence
  derived and/or modified sequence opt2 from VP1__Norovirus_and/or_Norovirus-like__GU270580
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcauccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15975 - RNA, 1617 nt, Artificial Sequence
  derived and/or modified sequence opt2 from VP1__Norovirus_and/or_Norovirus-like__EU876882
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 15976 - RNA, 1617 nt, Artificial Sequence
  derived and/or modified sequence opt2 from VP1__Norovirus_and/or_Norovirus-like__AB933649
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggcggcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15977 - RNA, 1617 nt, Artificial Sequence
  derived and/or modified sequence opt2 from VP1__Norovirus_and/or_Norovirus-like__JX439816
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15978 - RNA, 1617 nt, Artificial Sequence
  derived and/or modified sequence opt2 from VP1__Norovirus_and/or_Norovirus-like__JX155739
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15979 - RNA, 1617 nt, Artificial Sequence
  derived and/or modified sequence opt2 from VP1__Norovirus_and/or_Norovirus-like__HQ456338
augaagauggccuccaacgacgccucccccuccgacggcuccgccgccaaccucguccccgaggucaacaacgaggucauggcccucgagcccgucgucggcgccgccaucgccgcccccgucgccggccagaagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15980 - RNA, 1617 nt, Artificial Sequence
  derived and/or modified sequence opt2 from VP1__Norovirus_and/or_Norovirus-like__AB541359
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgaggucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15981 - RNA, 1617 nt, Artificial Sequence
  derived and/or modified sequence opt2 from VP1__Norovirus_and/or_Norovirus-like__AB541280
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccgcccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15982 - RNA, 1617 nt, Artificial Sequence
  derived and/or modified sequence opt2 from VP1__Norovirus_and/or_Norovirus-like__AB541244
augaagauggccuccaacgacgccaaccccuccgacggcuccgccgccaaccucguccccgaggucaacaacgagggcauggcccucgagcccgucgucggcgccgccaucgccgcccccgucgccggccagaccaacgucaucgaccccuggauccgcaacaacuucguccaggcccccggcggcgaguucaccgucuccccccgcaacgcccccuccgagauccucugguccgccucccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcaacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcuccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15983 - RNA, 1617 nt, Artificial Sequence
  derived and/or modified sequence opt2 from VP1__Norovirus_and/or_Norovirus-like__AB541203
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgucggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15984 - RNA, 1617 nt, Artificial Sequence
  derived and/or modified sequence opt2 from VP1__Norovirus_and/or_Norovirus-like__GQ850882
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccgucuucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15985 - RNA, 1617 nt, Artificial Sequence
  derived and/or modified sequence opt2 from VP1__Norovirus_and/or_Norovirus-like__KR131772
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15986 - RNA, 1617 nt, Artificial Sequence
  derived and/or modified sequence opt2 from VP1__Norovirus_and/or_Norovirus-like__KR904215
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccacccagaacugguccuccuacgaccccaccgaggagauccccgccccccucggcacccccgacuucgucggcaagauccagggcguccucacccagaccaccaagaccgacggcuccacccgcggccacaaggccaccgucuacaccggcuccgccgacuucgcccccaagcucggccgcguccaguucgccaccgacaccgacaacgacuucgaggccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 15987 - RNA, 1617 nt, Artificial Sequence
  derived and/or modified sequence opt2 from VP1__Norovirus_and/or_Norovirus-like__AB933715
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15988 - RNA, 1617 nt, Artificial Sequence
  derived and/or modified sequence opt2 from VP1__Norovirus_and/or_Norovirus-like__AB933695
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15989 - RNA, 1617 nt, Artificial Sequence
  derived and/or modified sequence opt2 from VP1__Norovirus_and/or_Norovirus-like__AB933681
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacgccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15990 - RNA, 1617 nt, Artificial Sequence
  derived and/or modified sequence opt2 from VP1__Norovirus_and/or_Norovirus-like__AB933675
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccaacucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15991 - RNA, 1617 nt, Artificial Sequence
  derived and/or modified sequence opt2 from VP1__Norovirus_and/or_Norovirus-like__AB933652
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15992 - RNA, 1617 nt, Artificial Sequence
  derived and/or modified sequence opt2 from VP1__Norovirus_and/or_Norovirus-like__KF429762
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15993 - RNA, 1617 nt, Artificial Sequence
  derived and/or modified sequence opt2 from VP1__Norovirus_and/or_Norovirus-like__JX644027
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgaguccaagaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacgcccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15994 - RNA, 1617 nt, Artificial Sequence
  derived and/or modified sequence opt2 from VP1__Norovirus_and/or_Norovirus-like__JN400617
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15995 - RNA, 1617 nt, Artificial Sequence
  derived and/or modified sequence opt2 from VP1__Norovirus_and/or_Norovirus-like__JQ613519
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15996 - RNA, 1617 nt, Artificial Sequence
  derived and/or modified sequence opt2 from VP1__Norovirus_and/or_Norovirus-like__HQ456341
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcgucuuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15997 - RNA, 1617 nt, Artificial Sequence
  derived and/or modified sequence opt2 from VP1__Norovirus_and/or_Norovirus-like__HM802540
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccagcucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 15998 - RNA, 1617 nt, Artificial Sequence
  derived and/or modified sequence opt2 from VP1__Norovirus_and/or_Norovirus-like__AB541257
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacgcccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 15999 - RNA, 1617 nt, Artificial Sequence
  derived and/or modified sequence opt2 from VP1__Norovirus_and/or_Norovirus-like__AB541242
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccucccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16000 - RNA, 1617 nt, Artificial Sequence
  derived and/or modified sequence opt2 from VP1__Norovirus_and/or_Norovirus-like__AB541225
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccggcgacgacuuccagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16001 - RNA, 1617 nt, Artificial Sequence
  derived and/or modified sequence opt2 from VP1__Norovirus_and/or_Norovirus-like__AB541190
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacauggcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16002 - RNA, 1617 nt, Artificial Sequence
  derived and/or modified sequence opt2 from VP1__Norovirus_and/or_Norovirus-like__AB492092
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16003 - RNA, 1617 nt, Artificial Sequence
  derived and/or modified sequence opt2 from VP1__Norovirus_and/or_Norovirus-like__EU916956
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacaccaaguucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16004 - RNA, 1617 nt, Artificial Sequence
  derived and/or modified sequence opt2 from VP1__Norovirus_and/or_Norovirus-like__EF126962
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccauccgccucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagguccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16005 - RNA, 1617 nt, Artificial Sequence
  derived and/or modified sequence opt2 from VP1__Norovirus_and/or_Norovirus-like__AB663687
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcaguuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16006 - RNA, 1617 nt, Artificial Sequence
  derived and/or modified sequence opt2 from VP1__Norovirus_and/or_Norovirus-like__AB933759
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16007 - RNA, 1617 nt, Artificial Sequence
  derived and/or modified sequence opt2 from VP1__Norovirus_and/or_Norovirus-like__AB933755
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16008 - RNA, 1617 nt, Artificial Sequence
  derived and/or modified sequence opt2 from VP1__Norovirus_and/or_Norovirus-like__AB933677
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccuccucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16009 - RNA, 1617 nt, Artificial Sequence
  derived and/or modified sequence opt2 from VP1__Norovirus_and/or_Norovirus-like__AB933650
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16010 - RNA, 1617 nt, Artificial Sequence
  derived and/or modified sequence opt2 from VP1__Norovirus_and/or_Norovirus-like__KM245071
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16011 - RNA, 1617 nt, Artificial Sequence
  derived and/or modified sequence opt2 from VP1__Norovirus_and/or_Norovirus-like__KF712497
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacugguccaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccauccaguucgccaccgacaccgagaacgacuucgagacccaccagaacacccgcuucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16012 - RNA, 1617 nt, Artificial Sequence
  derived and/or modified sequence opt2 from VP1__Norovirus_and/or_Norovirus-like__KC990829
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacaccgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16013 - RNA, 1617 nt, Artificial Sequence
  derived and/or modified sequence opt2 from VP1__Norovirus_and/or_Norovirus-like__JX439843
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucccccccgucaacaucugcaccuuccgcggcgacgucacccacaucgccggcucccgcgucuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacgcccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16014 - RNA, 1617 nt, Artificial Sequence
  derived and/or modified sequence opt2 from VP1__Norovirus_and/or_Norovirus-like__JX439841
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16015 - RNA, 1617 nt, Artificial Sequence
  derived and/or modified sequence opt2 from VP1__Norovirus_and/or_Norovirus-like__JX439830
augaagaugggcuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16016 - RNA, 1617 nt, Artificial Sequence
  derived and/or modified sequence opt2 from VP1__Norovirus_and/or_Norovirus-like__JX439828
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16017 - RNA, 1617 nt, Artificial Sequence
  derived and/or modified sequence opt2 from VP1__Norovirus_and/or_Norovirus-like__JX445153
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcgcccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgaccucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16018 - RNA, 1617 nt, Artificial Sequence
  derived and/or modified sequence opt2 from VP1__Norovirus_and/or_Norovirus-like__JX155754
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacgcccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16019 - RNA, 1617 nt, Artificial Sequence
  derived and/or modified sequence opt2 from VP1__Norovirus_and/or_Norovirus-like__JN400608
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16020 - RNA, 1617 nt, Artificial Sequence
  derived and/or modified sequence opt2 from VP1__Norovirus_and/or_Norovirus-like__EF187497
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccaucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccgucaacuucacccccaagcucggccgcauccaguucuccaccgacaccuccaacgacuucgagaccggccaguccacccgcuucacccccgucggcgucguccaggacggcuccaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16021 - RNA, 1617 nt, Artificial Sequence
  derived and/or modified sequence opt2 from VP1__Norovirus_and/or_Norovirus-like__AB668028
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16022 - RNA, 1617 nt, Artificial Sequence
  derived and/or modified sequence opt2 from VP1__Norovirus_and/or_Norovirus-like__HM802542
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggccgcauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16023 - RNA, 1617 nt, Artificial Sequence
  derived and/or modified sequence opt2 from VP1__Norovirus_and/or_Norovirus-like__HQ009513
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16024 - RNA, 1617 nt, Artificial Sequence
  derived and/or modified sequence opt2 from VP1__Norovirus_and/or_Norovirus-like__AB541322
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccaccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16025 - RNA, 1617 nt, Artificial Sequence
  derived and/or modified sequence opt2 from VP1__Norovirus_and/or_Norovirus-like__AB541321
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccagaacgcccccuccgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16026 - RNA, 1617 nt, Artificial Sequence
  derived and/or modified sequence opt2 from VP1__Norovirus_and/or_Norovirus-like__AB541253
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16027 - RNA, 1617 nt, Artificial Sequence
  derived and/or modified sequence opt2 from VP1__Norovirus_and/or_Norovirus-like__AB541250
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccaggacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16028 - RNA, 1617 nt, Artificial Sequence
  derived and/or modified sequence opt2 from VP1__Norovirus_and/or_Norovirus-like__AB541211
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16029 - RNA, 1617 nt, Artificial Sequence
  derived and/or modified sequence opt2 from VP1__Norovirus_and/or_Norovirus-like__GQ246797
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16030 - RNA, 1617 nt, Artificial Sequence
  derived and/or modified sequence opt2 from VP1__Norovirus_and/or_Norovirus-like__GQ246794
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccccugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16031 - RNA, 1617 nt, Artificial Sequence
  derived and/or modified sequence opt2 from VP1__Norovirus_and/or_Norovirus-like__EU876884
augaagauggccuccaacgacgccaaccccuccgacggcuccaccgccaaccucguccccgaggucaacuccgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccuccuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16032 - RNA, 1617 nt, Artificial Sequence
  derived and/or modified sequence opt2 from VP1__Norovirus_and/or_Norovirus-like__FJ411170
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucaccaccgacaccaacaacgacuucgagaccggccagaacaccaaguucacccccgucggcgucguccaggacggcaacuccacccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16033 - RNA, 1617 nt, Artificial Sequence
  derived and/or modified sequence opt2 from VP1__Norovirus_and/or_Norovirus-like__EU839589
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguuccgcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16034 - RNA, 1617 nt, Artificial Sequence
  derived and/or modified sequence opt2 from VP1__Norovirus_and/or_Norovirus-like__KX353961
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16035 - RNA, 1617 nt, Artificial Sequence
  derived and/or modified sequence opt2 from VP1__Norovirus_and/or_Norovirus-like__AB933757
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaccccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaggucgccaccgacaccaacaacgacuucgacgccaaccagaacaccaaguucacccccgucggcgucauccaggacggcggcaccacccaccgcaacgagccccagcaguggguccuccccuccuacuccggccgcaacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16036 - RNA, 1617 nt, Artificial Sequence
  derived and/or modified sequence opt2 from VP1__Norovirus_and/or_Norovirus-like__KM245074
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16037 - RNA, 1617 nt, Artificial Sequence
  derived and/or modified sequence opt2 from VP1__Norovirus_and/or_Norovirus-like__EU921368
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucaccaacaucgccggcucccagaccuacaccaugaaccucgccucccagaacuggaacaacuacgaccccaccgaggagauccccgccccccucggcacccccgacuucgucggcaagauccagggcguccucacccagaccaccaagggcgacggcuccacccgcggccacaaggccaccgucuccaccggcuccgcccaguucacccccaagcucggcuccguccaguucuccaccgacaccuccaccgacuucgagaccggccagaacacccgcuucacccccgucggcgucauccaggacggcuccaccacccacaagaacgagccccagcaguggguccuccccuccuacuccggccgcgacucccacaacguccaccucgcccccgccgucgcccccaccuuccccggcgagcagauccucuucuuccgcuccaccaugcccggcugcuccggcuaccccaacauggaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16038 - RNA, 1617 nt, Artificial Sequence
  derived and/or modified sequence opt2 from VP1__Norovirus_and/or_Norovirus-like__EU921338
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgccuacuccggccgcgacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16039 - RNA, 1617 nt, Artificial Sequence
  derived and/or modified sequence opt2 from VP1__Norovirus_and/or_Norovirus-like__LC005708
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16040 - RNA, 1617 nt, Artificial Sequence
  derived and/or modified sequence opt2 from VP1__Norovirus_and/or_Norovirus-like__LC005704
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16041 - RNA, 1617 nt, Artificial Sequence
  derived and/or modified sequence opt2 from VP1__Norovirus_and/or_Norovirus-like__KF429777
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacugguccaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacacccgcuucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16042 - RNA, 1617 nt, Artificial Sequence
  derived and/or modified sequence opt2 from VP1__Norovirus_and/or_Norovirus-like__JX439840
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcauccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16043 - RNA, 1617 nt, Artificial Sequence
  derived and/or modified sequence opt2 from VP1__Norovirus_and/or_Norovirus-like__JX644026
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacgcccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16044 - RNA, 1617 nt, Artificial Sequence
  derived and/or modified sequence opt2 from VP1__Norovirus_and/or_Norovirus-like__JX459906
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16045 - RNA, 1617 nt, Artificial Sequence
  derived and/or modified sequence opt2 from VP1__Norovirus_and/or_Norovirus-like__JX459597
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugccacgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggccgcauccagggcguccucacccagaccacccgccgcgacggcuccacccgcggccacaaggccacccucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16046 - RNA, 1617 nt, Artificial Sequence
  derived and/or modified sequence opt2 from VP1__Norovirus_and/or_Norovirus-like__HQ456334
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucaacaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16047 - RNA, 1617 nt, Artificial Sequence
  derived and/or modified sequence opt2 from VP1__Norovirus_and/or_Norovirus-like__HM802553
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagguccuccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucgucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucaccaacauccccggcucccgcaccuaccgcaugaaccucgccucccagaacuggaacaacuacgaccccaccgaggagauccccgccccccucggcacccccgacuucgucggcaagauccagggcguccucacccagaccaccaagggcgacggcuccacccgcggccacaaggccaccguccgcaccggcuccgccgacuucacccccaagcucggcuccguccaguucgccaccgacaccgacaacgacuucgucaccggccagaacacccgcuucacccccgucggcgucauccacgacggcuccuccgcccaccgcaacgagccccagcaguggguccuccccgaguacuccggccgcuccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16048 - RNA, 1617 nt, Artificial Sequence
  derived and/or modified sequence opt2 from VP1__Norovirus_and/or_Norovirus-like__HQ008055
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccaccgcgccaccgucuacaccggcuccgccgaguucgcccccaagcucggccgcguccaguucgccaccgacaccgagaacgacuucgacaccaaccagaacaccaaguucacccccgucggcgucauccaggacggcaacaccacccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaaccucgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16049 - RNA, 1617 nt, Artificial Sequence
  derived and/or modified sequence opt2 from VP1__Norovirus_and/or_Norovirus-like__AB541360
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagauccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcuga

SEQ ID NO: 16050 - RNA, 1617 nt, Artificial Sequence
  derived and/or modified sequence opt2 from VP1__Norovirus_and/or_Norovirus-like__AB541262
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacgucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16051 - RNA, 1617 nt, Artificial Sequence
  derived and/or modified sequence opt2 from VP1__Norovirus_and/or_Norovirus-like__AB541231
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgccguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16052 - RNA, 1617 nt, Artificial Sequence
  derived and/or modified sequence opt2 from VP1__Norovirus_and/or_Norovirus-like__GQ246792
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucacccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16053 - RNA, 1617 nt, Artificial Sequence
  derived and/or modified sequence opt2 from VP1__Norovirus_and/or_Norovirus-like__AB504329
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16054 - RNA, 1617 nt, Artificial Sequence
  derived and/or modified sequence opt2 from VP1__Norovirus_and/or_Norovirus-like__AB504306
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaagucccgcuuccccaucccccucgagaagcucuacaccggccccuccuccgccuucgucguccagccccagaacggccgcugcaccaccgacggcguccuccucggcaccacccagcucuccgucgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcuuccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgucuga

SEQ ID NO: 16055 - RNA, 1617 nt, Artificial Sequence
  derived and/or modified sequence opt2 from VP1__Norovirus_and/or_Norovirus-like__GQ303445
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgaccacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16056 - RNA, 1617 nt, Artificial Sequence
  derived and/or modified sequence opt2 from VP1__Norovirus_and/or_Norovirus-like__EU839588
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucgccgucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16057 - RNA, 1617 nt, Artificial Sequence
  derived and/or modified sequence opt2 from VP1__Norovirus_and/or_Norovirus-like__DQ364459
augaagauggccuccaacgacgccuccuccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucaccaccgacaccaacaacgacuucgagaccggccagaacaccaaguucacccccgucggcgucguccaggacggcaacuccacccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16058 - RNA, 1617 nt, Artificial Sequence
  derived and/or modified sequence opt2 from VP1__Norovirus_and/or_Norovirus-like__KY628449
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucucccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgacuucgccguccagccccagaacggccgcugcaccaccgacggcguccuccucggcaccacccagcucucccccgucaacaucugcaccuuccgcggcgacgucacccacaucaacggcuccuccaacuacaagaugaaccucgccaaccagaacugguccaacuacgaccccaccgaggagauccccgccccccucggcgcccccgacuucgucggcaagauccagggcguccucacccagaccaccaaggaggacggcuccacccgcggccacaaggccaccgucuacaccggcuccgccgacuucgcccccaagcucggccgcguccaguucgagaccgacaccgaccacgaccucgagaucgaccagaacaccaaguucacccccgucggcgucauccagaacggcggcaccacccaccgcaacgagcccaagcaguggaugcuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacuccggccagcacgaccucgucgucccccccaacggcuacuuccgcuucgacuccugggucaaccaguucuacacccucgcccccaugggcaacggcuccggccgccgccgcuga

SEQ ID NO: 16059 - RNA, 1617 nt, Artificial Sequence
  derived and/or modified sequence opt2 from VP1__Norovirus_and/or_Norovirus-like__KX371608
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaucaccaagggcgacggcuccacccgcggccacaaggccaccgucuacaccggcuccgccgacuucacccccaagcucggcuccguccaguucgccaccgacaccgagaacgacuuccagacccaccagaacacccgcuucacccccgucggcgucauccaggacggcggcaccacccaccagaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16060 - RNA, 1617 nt, Artificial Sequence
  derived and/or modified sequence opt2 from VP1__Norovirus_and/or_Norovirus-like__KX354089
augaagauggccuccaacgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16061 - RNA, 1617 nt, Artificial Sequence
  derived and/or modified sequence opt2 from VP1__Norovirus_and/or_Norovirus-like__KX354001
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacacccgcuucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16062 - RNA, 1617 nt, Artificial Sequence
  derived and/or modified sequence opt2 from VP1__Norovirus_and/or_Norovirus-like__KX353971
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16063 - RNA, 1617 nt, Artificial Sequence
  derived and/or modified sequence opt2 from VP1__Norovirus_and/or_Norovirus-like__KR131766
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16064 - RNA, 1617 nt, Artificial Sequence
  derived and/or modified sequence opt2 from VP1__Norovirus_and/or_Norovirus-like__AB663685
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcgccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16065 - RNA, 1617 nt, Artificial Sequence
  derived and/or modified sequence opt2 from VP1__Norovirus_and/or_Norovirus-like__AB933746
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16066 - RNA, 1617 nt, Artificial Sequence
  derived and/or modified sequence opt2 from VP1__Norovirus_and/or_Norovirus-like__AB933701
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16067 - RNA, 1617 nt, Artificial Sequence
  derived and/or modified sequence opt2 from VP1__Norovirus_and/or_Norovirus-like__AB933686
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16068 - RNA, 1617 nt, Artificial Sequence
  derived and/or modified sequence opt2 from VP1__Norovirus_and/or_Norovirus-like__AB933680
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccgcccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16069 - RNA, 1617 nt, Artificial Sequence
  derived and/or modified sequence opt2 from VP1__Norovirus_and/or_Norovirus-like__AB933672
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccgcccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16070 - RNA, 1617 nt, Artificial Sequence
  derived and/or modified sequence opt2 from VP1__Norovirus_and/or_Norovirus-like__AB933664
augaagauggccuccaacgacgccacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucaacaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16071 - RNA, 1617 nt, Artificial Sequence
  derived and/or modified sequence opt2 from VP1__Norovirus_and/or_Norovirus-like__AB933662
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaucuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16072 - RNA, 1617 nt, Artificial Sequence
  derived and/or modified sequence opt2 from VP1__Norovirus_and/or_Norovirus-like__AB933656
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16073 - RNA, 1617 nt, Artificial Sequence
  derived and/or modified sequence opt2 from VP1__Norovirus_and/or_Norovirus-like__EU921340
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16074 - RNA, 1617 nt, Artificial Sequence
  derived and/or modified sequence opt2 from VP1__Norovirus_and/or_Norovirus-like__KC962453
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccauccccguccucaccaucgaggagaugaccaacucccgcuuccccaucccccucgagaagcucuucaccggccccuccuccgccuucgucguccagccccagaacggccgcugcuccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccguccucaccggcuccgccaacuucacccccaagcucggccgcauccaguucgccaccgacaccgacaacgacuucgagaccaaccagaacaccaaguucacccccgucggcgucauccaggacggcgacaccgcccaccgcaacgagccccagcaguggguccuccccuccuacuccggccgcaacacccacaacguccaccucgcccccgccgucgcccccaccuuccccggcgagcagcuccucuucuuccgcuccaccauccccggcugcuccggcuaccccaacauggaccucgacugccuccucccccaggaguggguccaguucuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16075 - RNA, 1617 nt, Artificial Sequence
  derived and/or modified sequence opt2 from VP1__Norovirus_and/or_Norovirus-like__KF712501
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcuccuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16076 - RNA, 1617 nt, Artificial Sequence
  derived and/or modified sequence opt2 from VP1__Norovirus_and/or_Norovirus-like__JX459903
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgaccacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccaccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16077 - RNA, 1617 nt, Artificial Sequence
  derived and/or modified sequence opt2 from VP1__Norovirus_and/or_Norovirus-like__JX459629
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16078 - RNA, 1617 nt, Artificial Sequence
  derived and/or modified sequence opt2 from VP1__Norovirus_and/or_Norovirus-like__JX445165
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccgacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16079 - RNA, 1617 nt, Artificial Sequence
  derived and/or modified sequence opt2 from VP1__Norovirus_and/or_Norovirus-like__HM635156
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaucgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16080 - RNA, 1617 nt, Artificial Sequence
  derived and/or modified sequence opt2 from VP1__Norovirus_and/or_Norovirus-like__JQ622197
augaagauggccuccaacgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16081 - RNA, 1617 nt, Artificial Sequence
  derived and/or modified sequence opt2 from VP1__Norovirus_and/or_Norovirus-like__JQ613520
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucauccccuccaacggcuacuuccgcuucgacuccugggucaaccaguucuacacccucgcccccaugggcaacggcaccggccgccgccgcuga

SEQ ID NO: 16082 - RNA, 1617 nt, Artificial Sequence
  derived and/or modified sequence opt2 from VP1__Norovirus_and/or_Norovirus-like__HQ456320
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16083 - RNA, 1617 nt, Artificial Sequence
  derived and/or modified sequence opt2 from VP1__Norovirus_and/or_Norovirus-like__AB541353
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16084 - RNA, 1617 nt, Artificial Sequence
  derived and/or modified sequence opt2 from VP1__Norovirus_and/or_Norovirus-like__AB541348
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16085 - RNA, 1617 nt, Artificial Sequence
  derived and/or modified sequence opt2 from VP1__Norovirus_and/or_Norovirus-like__AB541339
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16086 - RNA, 1617 nt, Artificial Sequence
  derived and/or modified sequence opt2 from VP1__Norovirus_and/or_Norovirus-like__AB541303
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgucuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16087 - RNA, 1617 nt, Artificial Sequence
  derived and/or modified sequence opt2 from VP1__Norovirus_and/or_Norovirus-like__GQ246799
augaagauggccuccaacgacgccaaccccuccgacggcuccgccgccaaccucguccccgagaucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccccgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16088 - RNA, 1617 nt, Artificial Sequence
  derived and/or modified sequence opt2 from VP1__Norovirus_and/or_Norovirus-like__EU876886
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucuccuccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16089 - RNA, 1617 nt, Artificial Sequence
  derived and/or modified sequence opt2 from VP1__Norovirus_and/or_Norovirus-like__AB385630
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16090 - RNA, 1617 nt, Artificial Sequence
  derived and/or modified sequence opt2 from VP1__Norovirus_and/or_Norovirus-like__KU182483
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16091 - RNA, 1617 nt, Artificial Sequence
  derived and/or modified sequence opt2 from VP1__Norovirus_and/or_Norovirus-like__AB665364
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16092 - RNA, 1617 nt, Artificial Sequence
  derived and/or modified sequence opt2 from VP1__Norovirus_and/or_Norovirus-like__AB663686
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucuccuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16093 - RNA, 1617 nt, Artificial Sequence
  derived and/or modified sequence opt2 from VP1__Norovirus_and/or_Norovirus-like__AB933702
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16094 - RNA, 1617 nt, Artificial Sequence
  derived and/or modified sequence opt2 from VP1__Norovirus_and/or_Norovirus-like__AB933685
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccgcuucuccaccgacaccgagaacgacuucgagauccaccagaacaccaaguucacccccgucggcgucauccaggacggcuccaccacccaccgcaacgagccccagcaguggguccuccccuccuacuccggccgcgacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16095 - RNA, 1617 nt, Artificial Sequence
  derived and/or modified sequence opt2 from VP1__Norovirus_and/or_Norovirus-like__AB933645
augaagauggccuccaacgacgccacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16096 - RNA, 1617 nt, Artificial Sequence
  derived and/or modified sequence opt2 from VP1__Norovirus_and/or_Norovirus-like__LC005706
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16097 - RNA, 1617 nt, Artificial Sequence
  derived and/or modified sequence opt2 from VP1__Norovirus_and/or_Norovirus-like__KM198562
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16098 - RNA, 1617 nt, Artificial Sequence
  derived and/or modified sequence opt2 from VP1__Norovirus_and/or_Norovirus-like__KC409311
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccaacaacgaccucggcgccaaccagaacaccaaguucacccccgucggcgucauccaggacggcggcaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16099 - RNA, 1617 nt, Artificial Sequence
  derived and/or modified sequence opt2 from VP1__Norovirus_and/or_Norovirus-like__KC409263
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16100 - RNA, 1617 nt, Artificial Sequence
  derived and/or modified sequence opt2 from VP1__Norovirus_and/or_Norovirus-like__JX459900
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16101 - RNA, 1617 nt, Artificial Sequence
  derived and/or modified sequence opt2 from VP1__Norovirus_and/or_Norovirus-like__JX459617
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16102 - RNA, 1617 nt, Artificial Sequence
  derived and/or modified sequence opt2 from VP1__Norovirus_and/or_Norovirus-like__GQ845366
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccaacuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucauccccuccaacggcuacuuccgcuucgacuccugggucaaccaguucuacacccucgcccccaugggcaacggcaccggccgccgccgcuga

SEQ ID NO: 16103 - RNA, 1617 nt, Artificial Sequence
  derived and/or modified sequence opt2 from VP1__Norovirus_and/or_Norovirus-like__GQ845345
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgacaugaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucgccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16104 - RNA, 1617 nt, Artificial Sequence
  derived and/or modified sequence opt2 from VP1__Norovirus_and/or_Norovirus-like__GQ845341
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccgagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16105 - RNA, 1617 nt, Artificial Sequence
  derived and/or modified sequence opt2 from VP1__Norovirus_and/or_Norovirus-like__HQ005292
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16106 - RNA, 1617 nt, Artificial Sequence
  derived and/or modified sequence opt2 from VP1__Norovirus_and/or_Norovirus-like__HQ456321
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccgucaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16107 - RNA, 1617 nt, Artificial Sequence
  derived and/or modified sequence opt2 from VP1__Norovirus_and/or_Norovirus-like__AB541326
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16108 - RNA, 1617 nt, Artificial Sequence
  derived and/or modified sequence opt2 from VP1__Norovirus_and/or_Norovirus-like__AB541251
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgucucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcuga

SEQ ID NO: 16109 - RNA, 1617 nt, Artificial Sequence
  derived and/or modified sequence opt2 from VP1__Norovirus_and/or_Norovirus-like__AB541241
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccaucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcggcguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16110 - RNA, 1617 nt, Artificial Sequence
  derived and/or modified sequence opt2 from VP1__Norovirus_and/or_Norovirus-like__AB541216
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16111 - RNA, 1617 nt, Artificial Sequence
  derived and/or modified sequence opt2 from VP1__Norovirus_and/or_Norovirus-like__EU876885
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgccaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccaacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16112 - RNA, 1617 nt, Artificial Sequence
  derived and/or modified sequence opt2 from VP1__Norovirus_and/or_Norovirus-like__AB447435
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16113 - RNA, 1617 nt, Artificial Sequence
  derived and/or modified sequence opt2 from VP1__Norovirus_and/or_Norovirus-like__KX354073
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacacccgcuucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16114 - RNA, 1617 nt, Artificial Sequence
  derived and/or modified sequence opt2 from VP1__Norovirus_and/or_Norovirus-like__KX353981
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16115 - RNA, 1617 nt, Artificial Sequence
  derived and/or modified sequence opt2 from VP1__Norovirus_and/or_Norovirus-like__KU182479
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcgcccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16116 - RNA, 1617 nt, Artificial Sequence
  derived and/or modified sequence opt2 from VP1__Norovirus_and/or_Norovirus-like__KU182478
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccuggaucaaccaguucuacacccucgcccccaugggcaacggcgccggccgccgccgcuga

SEQ ID NO: 16117 - RNA, 1617 nt, Artificial Sequence
  derived and/or modified sequence opt2 from VP1__Norovirus_and/or_Norovirus-like__AB972501
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16118 - RNA, 1617 nt, Artificial Sequence
  derived and/or modified sequence opt2 from VP1__Norovirus_and/or_Norovirus-like__KR904214
augaagauggccuccuccgacgccaaccccuccgucggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccucgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccacccagaacuggaacuccuacgaccccaccgaggagauccccgccccccucggcacccccgacuucgucggcaagauccagggcguccucacccagaccaccaagaccgacggcuccacccgcggccacaaggccaccgucuacaccggcuccgccgacuucgcccccaagcucggccgcguccaguucgccaccgacaccgacaacgacuucgaggccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 16119 - RNA, 1617 nt, Artificial Sequence
  derived and/or modified sequence opt2 from VP1__Norovirus_and/or_Norovirus-like__AB933758
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16120 - RNA, 1617 nt, Artificial Sequence
  derived and/or modified sequence opt2 from VP1__Norovirus_and/or_Norovirus-like__AB933698
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuucaagggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccagaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16121 - RNA, 1617 nt, Artificial Sequence
  derived and/or modified sequence opt2 from VP1__Norovirus_and/or_Norovirus-like__KJ678141
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccaacggcuccacccgcggccacaaggccaccgucuacgccggcuccgccaacuucgcccccaagcucggccgcguccaguucgagaccgacaccgaccacgaccucgaggccaaccagaacaccaaguucacccccgucggcgucauccaggacggcaacaccacccaccgcaacgagccccagcaguggguccuccccuccuacuccggccgcuccacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16122 - RNA, 1617 nt, Artificial Sequence
  derived and/or modified sequence opt2 from VP1__Norovirus_and/or_Norovirus-like__EU921347
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagguccuccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16123 - RNA, 1617 nt, Artificial Sequence
  derived and/or modified sequence opt2 from VP1__Norovirus_and/or_Norovirus-like__JX459628
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16124 - RNA, 1617 nt, Artificial Sequence
  derived and/or modified sequence opt2 from VP1__Norovirus_and/or_Norovirus-like__JQ613564
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccgccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgaguucucccccaagcucggccgcguccaguucgccaccgacaccgacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16125 - RNA, 1617 nt, Artificial Sequence
  derived and/or modified sequence opt2 from VP1__Norovirus_and/or_Norovirus-like__GQ845332
augaagauggccuccaacgacgccaaccccuccaacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16126 - RNA, 1617 nt, Artificial Sequence
  derived and/or modified sequence opt2 from VP1__Norovirus_and/or_Norovirus-like__GQ856461
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucaugggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16127 - RNA, 1617 nt, Artificial Sequence
  derived and/or modified sequence opt2 from VP1__Norovirus_and/or_Norovirus-like__AB541245
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16128 - RNA, 1617 nt, Artificial Sequence
  derived and/or modified sequence opt2 from VP1__Norovirus_and/or_Norovirus-like__AB541229
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16129 - RNA, 1617 nt, Artificial Sequence
  derived and/or modified sequence opt2 from VP1__Norovirus_and/or_Norovirus-like__AB541226
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucacccccaugggcaacggcaccggccgccgccgcuga

SEQ ID NO: 16130 - RNA, 1617 nt, Artificial Sequence
  derived and/or modified sequence opt2 from VP1__Norovirus_and/or_Norovirus-like__DQ078814
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagguccucucccccucccaggucaccauguucccccacaucaucgucgacguccgccagcucgagcccguccucaucccccuccccgacguccgcaacaaccucuaccacuacaaccaguccaacgaccccaccauccgccucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggccgcauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16131 - RNA, 1617 nt, Artificial Sequence
  derived and/or modified sequence opt2 from VP1__Norovirus_and/or_Norovirus-like__EU078416
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16132 - RNA, 1617 nt, Artificial Sequence
  derived and/or modified sequence opt2 from VP1__Norovirus_and/or_Norovirus-like__EU839590
augaagauggccuccaacgacgccaaccccuccggcggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccaggacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16133 - RNA, 1617 nt, Artificial Sequence
  derived and/or modified sequence opt2 from VP1__Norovirus_and/or_Norovirus-like__AB294783
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16134 - RNA, 1617 nt, Artificial Sequence
  derived and/or modified sequence opt2 from VP1__Norovirus_and/or_Norovirus-like__AB303941
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccauccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16135 - RNA, 1617 nt, Artificial Sequence
  derived and/or modified sequence opt2 from VP1__Norovirus_and/or_Norovirus-like__EF126961
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgaggccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcgccggccgccgccgcuga

SEQ ID NO: 16136 - RNA, 1617 nt, Artificial Sequence
  derived and/or modified sequence opt2 from VP1__Norovirus_and/or_Norovirus-like__LC153749
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccaggacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16137 - RNA, 1617 nt, Artificial Sequence
  derived and/or modified sequence opt2 from VP1__Norovirus_and/or_Norovirus-like__KX371610
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucggcaccgacaccgaccacgacuucgaggccaaccaguccaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16138 - RNA, 1617 nt, Artificial Sequence
  derived and/or modified sequence opt2 from VP1__Norovirus_and/or_Norovirus-like__KX354031
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucggcaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16139 - RNA, 1617 nt, Artificial Sequence
  derived and/or modified sequence opt2 from VP1__Norovirus_and/or_Norovirus-like__KX353990
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16140 - RNA, 1617 nt, Artificial Sequence
  derived and/or modified sequence opt2 from VP1__Norovirus_and/or_Norovirus-like__KX353972
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16141 - RNA, 1617 nt, Artificial Sequence
  derived and/or modified sequence opt2 from VP1__Norovirus_and/or_Norovirus-like__KX353968
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacacccgcuucacccccgucggcgucauccaggacggcggcaccacccaccgcaacgagccccagcaguggguccuccccuccuacuccggccgcaacauccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16142 - RNA, 1617 nt, Artificial Sequence
  derived and/or modified sequence opt2 from VP1__Norovirus_and/or_Norovirus-like__KX353967
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacacccgcuucacccccgucggcgucauccaggacggcggcaccacccaccgcaacgagccccagcaguggguccuccccuccuacuccggccgcaacauccacaacguccaccucgcccccgccgucgcccccaacuuccccggcgagcagcuccucuucuuccgcuccaccaugcccggcugcuccggcuaccccaacgucgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16143 - RNA, 1617 nt, Artificial Sequence
  derived and/or modified sequence opt2 from VP1__Norovirus_and/or_Norovirus-like__KX353966
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccagaucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucaaccacaucgccggcucccgcaacuacaccaugaaccucgccucccucaacuggaacaacuacgaccccaccgaggagacccccgccccccucggcacccccgacuucgucggcaagauccagggcguccucacccagaccacccgcggcaacggcuccacccgcggccaccgcgccaccgucuacaccggcuccgccgacuucacccccaagcucggccgcauccaguucgccaccgacaccgacaacgacuucgagacccaccagaacaccaaguucacccccgucggcgucauccaggacggcaacaccacccaccgcaacgagccccagcaguggguccuccccuccuacuccggccgcaacguccagaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuucgucaccgucgcccacaccggccagcacgaccucgucaucccccccaacggcuacuuccgcuucgacuccugggucaaccaguucuacacccucgcccccaugggcaagggcaccggccgccgccgcuga

SEQ ID NO: 16144 - RNA, 1617 nt, Artificial Sequence
  derived and/or modified sequence opt2 from VP1__Norovirus_and/or_Norovirus-like__AB663684
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16145 - RNA, 1617 nt, Artificial Sequence
  derived and/or modified sequence opt2 from VP1__Norovirus_and/or_Norovirus-like__KR904209
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccaacaacgacuucgacgccaaccagaacaccaaguucacccccgucggcgucauccaggacggcgagaccgcccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggagcucgacugccucaucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16146 - RNA, 1617 nt, Artificial Sequence
  derived and/or modified sequence opt2 from VP1__Norovirus_and/or_Norovirus-like__AB933716
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16147 - RNA, 1617 nt, Artificial Sequence
  derived and/or modified sequence opt2 from VP1__Norovirus_and/or_Norovirus-like__AB933666
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccaggacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16148 - RNA, 1617 nt, Artificial Sequence
  derived and/or modified sequence opt2 from VP1__Norovirus_and/or_Norovirus-like__EU921349
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16149 - RNA, 1617 nt, Artificial Sequence
  derived and/or modified sequence opt2 from VP1__Norovirus_and/or_Norovirus-like__EU921348
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccgucaacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16150 - RNA, 1617 nt, Artificial Sequence
  derived and/or modified sequence opt2 from VP1__Norovirus_and/or_Norovirus-like__EU921345
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccgacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16151 - RNA, 1617 nt, Artificial Sequence
  derived and/or modified sequence opt2 from VP1__Norovirus_and/or_Norovirus-like__KP698924
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcauccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16152 - RNA, 1617 nt, Artificial Sequence
  derived and/or modified sequence opt2 from VP1__Norovirus_and/or_Norovirus-like__LC005707
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgaccagggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16153 - RNA, 1617 nt, Artificial Sequence
  derived and/or modified sequence opt2 from VP1__Norovirus_and/or_Norovirus-like__KJ541743
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16154 - RNA, 1617 nt, Artificial Sequence
  derived and/or modified sequence opt2 from VP1__Norovirus_and/or_Norovirus-like__KF177443
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucggcaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16155 - RNA, 1617 nt, Artificial Sequence
  derived and/or modified sequence opt2 from VP1__Norovirus_and/or_Norovirus-like__JX439842
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgucuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacgcccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16156 - RNA, 1617 nt, Artificial Sequence
  derived and/or modified sequence opt2 from VP1__Norovirus_and/or_Norovirus-like__HF952135
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccgcccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16157 - RNA, 1617 nt, Artificial Sequence
  derived and/or modified sequence opt2 from VP1__Norovirus_and/or_Norovirus-like__JX459598
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggcacgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccauccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16158 - RNA, 1617 nt, Artificial Sequence
  derived and/or modified sequence opt2 from VP1__Norovirus_and/or_Norovirus-like__JX445162
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucaucaucccccccaacggcuacuuccgcuucgacuccugggucaaccaguucuacacccucgcccccaugggcaacggcaccggccgccgccgcuga

SEQ ID NO: 16159 - RNA, 1617 nt, Artificial Sequence
  derived and/or modified sequence opt2 from VP1__Norovirus_and/or_Norovirus-like__JX445154
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16160 - RNA, 1617 nt, Artificial Sequence
  derived and/or modified sequence opt2 from VP1__Norovirus_and/or_Norovirus-like__JX155752
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacgccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuaccucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16161 - RNA, 1617 nt, Artificial Sequence
  derived and/or modified sequence opt2 from VP1__Norovirus_and/or_Norovirus-like__HM748971
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcagugggcccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16162 - RNA, 1617 nt, Artificial Sequence
  derived and/or modified sequence opt2 from VP1__Norovirus_and/or_Norovirus-like__GQ845367
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgacaugaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16163 - RNA, 1617 nt, Artificial Sequence
  derived and/or modified sequence opt2 from VP1__Norovirus_and/or_Norovirus-like__GQ856455
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccacggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16164 - RNA, 1617 nt, Artificial Sequence
  derived and/or modified sequence opt2 from VP1__Norovirus_and/or_Norovirus-like__GQ856447
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccaaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16165 - RNA, 1617 nt, Artificial Sequence
  derived and/or modified sequence opt2 from VP1__Norovirus_and/or_Norovirus-like__AB541318
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16166 - RNA, 1617 nt, Artificial Sequence
  derived and/or modified sequence opt2 from VP1__Norovirus_and/or_Norovirus-like__AB541307
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucauccccuccaacggcuacuuccgcuucgacuccugggucaaccaguucuacacccucgcccccaugggcaacggcaccggccgccgccgcuga

SEQ ID NO: 16167 - RNA, 1617 nt, Artificial Sequence
  derived and/or modified sequence opt2 from VP1__Norovirus_and/or_Norovirus-like__AB541254
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucgucaaggcccccggcggcgaguucaccgucuccccccgcaacucccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16168 - RNA, 1617 nt, Artificial Sequence
  derived and/or modified sequence opt2 from VP1__Norovirus_and/or_Norovirus-like__AB541243
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccccugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16169 - RNA, 1617 nt, Artificial Sequence
  derived and/or modified sequence opt2 from VP1__Norovirus_and/or_Norovirus-like__AB541232
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16170 - RNA, 1617 nt, Artificial Sequence
  derived and/or modified sequence opt2 from VP1__Norovirus_and/or_Norovirus-like__GQ246800
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccccgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16171 - RNA, 1617 nt, Artificial Sequence
  derived and/or modified sequence opt2 from VP1__Norovirus_and/or_Norovirus-like__GU390900
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16172 - RNA, 1617 nt, Artificial Sequence
  derived and/or modified sequence opt2 from VP1__Norovirus_and/or_Norovirus-like__AB504328
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucaccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcaucaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16173 - RNA, 1617 nt, Artificial Sequence
  derived and/or modified sequence opt2 from VP1__Norovirus_and/or_Norovirus-like__AB447434
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16174 - RNA, 1617 nt, Artificial Sequence
  derived and/or modified sequence opt2 from VP1__Norovirus_and/or_Norovirus-like__EU839591
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccgcggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16175 - RNA, 1617 nt, Artificial Sequence
  derived and/or modified sequence opt2 from VP1__Norovirus_and/or_Norovirus-like__AB291542
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggccacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16176 - RNA, 1617 nt, Artificial Sequence
  derived and/or modified sequence opt2 from VP1__Norovirus_and/or_Norovirus-like__KX354123
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccacccucuacaccggcuccgccgaguucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccaccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16177 - RNA, 1617 nt, Artificial Sequence
  derived and/or modified sequence opt2 from VP1__Norovirus_and/or_Norovirus-like__KX354050
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggccucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16178 - RNA, 1617 nt, Artificial Sequence
  derived and/or modified sequence opt2 from VP1__Norovirus_and/or_Norovirus-like__AB933717
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16179 - RNA, 1617 nt, Artificial Sequence
  derived and/or modified sequence opt2 from VP1__Norovirus_and/or_Norovirus-like__AB933707
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16180 - RNA, 1617 nt, Artificial Sequence
  derived and/or modified sequence opt2 from VP1__Norovirus_and/or_Norovirus-like__AB933705
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagacccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16181 - RNA, 1617 nt, Artificial Sequence
  derived and/or modified sequence opt2 from VP1__Norovirus_and/or_Norovirus-like__AB933704
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcuga

SEQ ID NO: 16182 - RNA, 1617 nt, Artificial Sequence
  derived and/or modified sequence opt2 from VP1__Norovirus_and/or_Norovirus-like__AB933699
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccagcucaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16183 - RNA, 1617 nt, Artificial Sequence
  derived and/or modified sequence opt2 from VP1__Norovirus_and/or_Norovirus-like__AB933679
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16184 - RNA, 1617 nt, Artificial Sequence
  derived and/or modified sequence opt2 from VP1__Norovirus_and/or_Norovirus-like__AB933661
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgagccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16185 - RNA, 1617 nt, Artificial Sequence
  derived and/or modified sequence opt2 from VP1__Norovirus_and/or_Norovirus-like__KT152148
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16186 - RNA, 1617 nt, Artificial Sequence
  derived and/or modified sequence opt2 from VP1__Norovirus_and/or_Norovirus-like__EU921393
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcuccaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16187 - RNA, 1617 nt, Artificial Sequence
  derived and/or modified sequence opt2 from VP1__Norovirus_and/or_Norovirus-like__KM396961
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccguccgcaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16188 - RNA, 1617 nt, Artificial Sequence
  derived and/or modified sequence opt2 from VP1__Norovirus_and/or_Norovirus-like__KM198485
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16189 - RNA, 1617 nt, Artificial Sequence
  derived and/or modified sequence opt2 from VP1__Norovirus_and/or_Norovirus-like__KF306214
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggucaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaacggccagcacgaccucgucaucccccccaacggcuacuuccgcuucgacuccugggucaaccaguucuacacccucgcccccaugggcaacggcaccggccgccgccgcuga

SEQ ID NO: 16190 - RNA, 1617 nt, Artificial Sequence
  derived and/or modified sequence opt2 from VP1__Norovirus_and/or_Norovirus-like__JX439831
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaucgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcaguuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16191 - RNA, 1617 nt, Artificial Sequence
  derived and/or modified sequence opt2 from VP1__Norovirus_and/or_Norovirus-like__KC409281
augaagauggccuccaacgacgccaaccccuccgacggcuccgccgccucccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16192 - RNA, 1617 nt, Artificial Sequence
  derived and/or modified sequence opt2 from VP1__Norovirus_and/or_Norovirus-like__JX459639
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16193 - RNA, 1617 nt, Artificial Sequence
  derived and/or modified sequence opt2 from VP1__Norovirus_and/or_Norovirus-like__JX459609
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgccguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16194 - RNA, 1617 nt, Artificial Sequence
  derived and/or modified sequence opt2 from VP1__Norovirus_and/or_Norovirus-like__JN400599
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccaccucccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16195 - RNA, 1617 nt, Artificial Sequence
  derived and/or modified sequence opt2 from VP1__Norovirus_and/or_Norovirus-like__JQ613539
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccucaucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16196 - RNA, 1617 nt, Artificial Sequence
  derived and/or modified sequence opt2 from VP1__Norovirus_and/or_Norovirus-like__HQ456329
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuaccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16197 - RNA, 1617 nt, Artificial Sequence
  derived and/or modified sequence opt2 from VP1__Norovirus_and/or_Norovirus-like__HM802536
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcgcccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16198 - RNA, 1617 nt, Artificial Sequence
  derived and/or modified sequence opt2 from VP1__Norovirus_and/or_Norovirus-like__HM802532
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16199 - RNA, 1617 nt, Artificial Sequence
  derived and/or modified sequence opt2 from VP1__Norovirus_and/or_Norovirus-like__AB541341
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16200 - RNA, 1617 nt, Artificial Sequence
  derived and/or modified sequence opt2 from VP1__Norovirus_and/or_Norovirus-like__AB541264
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16201 - RNA, 1617 nt, Artificial Sequence
  derived and/or modified sequence opt2 from VP1__Norovirus_and/or_Norovirus-like__AB541236
augaagauggccuccaacgacgccaaccccuccgacggcuccgccgccaaccucguccaggaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16202 - RNA, 1617 nt, Artificial Sequence
  derived and/or modified sequence opt2 from VP1__Norovirus_and/or_Norovirus-like__AB541208
augaagauggccuccaacgaccccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16203 - RNA, 1617 nt, Artificial Sequence
  derived and/or modified sequence opt2 from VP1__Norovirus_and/or_Norovirus-like__EU876890
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaacuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16204 - RNA, 1617 nt, Artificial Sequence
  derived and/or modified sequence opt2 from VP1__Norovirus_and/or_Norovirus-like__AB385638
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccaacacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggcggcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16205 - RNA, 1617 nt, Artificial Sequence
  derived and/or modified sequence opt2 from VP1__Norovirus_and/or_Norovirus-like__AB385635
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgacuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgaccucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16206 - RNA, 1617 nt, Artificial Sequence
  derived and/or modified sequence opt2 from VP1__Norovirus_and/or_Norovirus-like__EU366113
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguccuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccguccccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16207 - RNA, 1617 nt, Artificial Sequence
  derived and/or modified sequence opt2 from VP1__Norovirus_and/or_Norovirus-like__KX354097
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccaccaagaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16208 - RNA, 1617 nt, Artificial Sequence
  derived and/or modified sequence opt2 from VP1__Norovirus_and/or_Norovirus-like__AB933727
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16209 - RNA, 1617 nt, Artificial Sequence
  derived and/or modified sequence opt2 from VP1__Norovirus_and/or_Norovirus-like__AB933726
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16210 - RNA, 1617 nt, Artificial Sequence
  derived and/or modified sequence opt2 from VP1__Norovirus_and/or_Norovirus-like__AB933720
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagguccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16211 - RNA, 1617 nt, Artificial Sequence
  derived and/or modified sequence opt2 from VP1__Norovirus_and/or_Norovirus-like__AB933691
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16212 - RNA, 1617 nt, Artificial Sequence
  derived and/or modified sequence opt2 from VP1__Norovirus_and/or_Norovirus-like__AB933682
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16213 - RNA, 1617 nt, Artificial Sequence
  derived and/or modified sequence opt2 from VP1__Norovirus_and/or_Norovirus-like__KM245069
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccuccacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16214 - RNA, 1617 nt, Artificial Sequence
  derived and/or modified sequence opt2 from VP1__Norovirus_and/or_Norovirus-like__LC005717
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggaucaagaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16215 - RNA, 1617 nt, Artificial Sequence
  derived and/or modified sequence opt2 from VP1__Norovirus_and/or_Norovirus-like__LC005705
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16216 - RNA, 1617 nt, Artificial Sequence
  derived and/or modified sequence opt2 from VP1__Norovirus_and/or_Norovirus-like__KC894943
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccaacuacuccggcuccgacguccccaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16217 - RNA, 1617 nt, Artificial Sequence
  derived and/or modified sequence opt2 from VP1__Norovirus_and/or_Norovirus-like__KF060023
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucggcaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16218 - RNA, 1617 nt, Artificial Sequence
  derived and/or modified sequence opt2 from VP1__Norovirus_and/or_Norovirus-like__KC409310
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16219 - RNA, 1617 nt, Artificial Sequence
  derived and/or modified sequence opt2 from VP1__Norovirus_and/or_Norovirus-like__JX989073
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacauccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16220 - RNA, 1617 nt, Artificial Sequence
  derived and/or modified sequence opt2 from VP1__Norovirus_and/or_Norovirus-like__JX459902
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccuccuuccccaucgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucacccacaucuccggcucccgcaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16221 - RNA, 1617 nt, Artificial Sequence
  derived and/or modified sequence opt2 from VP1__Norovirus_and/or_Norovirus-like__JX459644
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacaugaaccucgacugccucaucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16222 - RNA, 1617 nt, Artificial Sequence
  derived and/or modified sequence opt2 from VP1__Norovirus_and/or_Norovirus-like__JX459610
augaagauggccuccaacgacgcccaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaccaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16223 - RNA, 1617 nt, Artificial Sequence
  derived and/or modified sequence opt2 from VP1__Norovirus_and/or_Norovirus-like__JX459606
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggcgcgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16224 - RNA, 1617 nt, Artificial Sequence
  derived and/or modified sequence opt2 from VP1__Norovirus_and/or_Norovirus-like__JX445159
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccgagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16225 - RNA, 1617 nt, Artificial Sequence
  derived and/or modified sequence opt2 from VP1__Norovirus_and/or_Norovirus-like__JN400606
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16226 - RNA, 1617 nt, Artificial Sequence
  derived and/or modified sequence opt2 from VP1__Norovirus_and/or_Norovirus-like__JQ613562
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaaguccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgacaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgcaagcgcuga

SEQ ID NO: 16227 - RNA, 1617 nt, Artificial Sequence
  derived and/or modified sequence opt2 from VP1__Norovirus_and/or_Norovirus-like__HQ456343
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcuccaccacccaccgcaacgagccccagcagugggucccccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16228 - RNA, 1617 nt, Artificial Sequence
  derived and/or modified sequence opt2 from VP1__Norovirus_and/or_Norovirus-like__HQ456342
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcggcaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16229 - RNA, 1617 nt, Artificial Sequence
  derived and/or modified sequence opt2 from VP1__Norovirus_and/or_Norovirus-like__HQ456340
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucuccuccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16230 - RNA, 1617 nt, Artificial Sequence
  derived and/or modified sequence opt2 from VP1__Norovirus_and/or_Norovirus-like__HQ456326
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16231 - RNA, 1617 nt, Artificial Sequence
  derived and/or modified sequence opt2 from VP1__Norovirus_and/or_Norovirus-like__HM802527
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucacccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16232 - RNA, 1617 nt, Artificial Sequence
  derived and/or modified sequence opt2 from VP1__Norovirus_and/or_Norovirus-like__GQ856448
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16233 - RNA, 1617 nt, Artificial Sequence
  derived and/or modified sequence opt2 from VP1__Norovirus_and/or_Norovirus-like__AB541347
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccguccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16234 - RNA, 1617 nt, Artificial Sequence
  derived and/or modified sequence opt2 from VP1__Norovirus_and/or_Norovirus-like__AB541298
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucaccccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgaccucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16235 - RNA, 1617 nt, Artificial Sequence
  derived and/or modified sequence opt2 from VP1__Norovirus_and/or_Norovirus-like__AB541270
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcuga

SEQ ID NO: 16236 - RNA, 1617 nt, Artificial Sequence
  derived and/or modified sequence opt2 from VP1__Norovirus_and/or_Norovirus-like__AB541263
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacgucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16237 - RNA, 1617 nt, Artificial Sequence
  derived and/or modified sequence opt2 from VP1__Norovirus_and/or_Norovirus-like__AB541256
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccucaucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16238 - RNA, 1617 nt, Artificial Sequence
  derived and/or modified sequence opt2 from VP1__Norovirus_and/or_Norovirus-like__AB541240
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccuccgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccuccaucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccagaacgagccccagcaguggguccuccccggcuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16239 - RNA, 1617 nt, Artificial Sequence
  derived and/or modified sequence opt2 from VP1__Norovirus_and/or_Norovirus-like__AB541233
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16240 - RNA, 1617 nt, Artificial Sequence
  derived and/or modified sequence opt2 from VP1__Norovirus_and/or_Norovirus-like__AB541215
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccccugguccgagccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16241 - RNA, 1617 nt, Artificial Sequence
  derived and/or modified sequence opt2 from VP1__Norovirus_and/or_Norovirus-like__AB541201
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16242 - RNA, 1617 nt, Artificial Sequence
  derived and/or modified sequence opt2 from VP1__Norovirus_and/or_Norovirus-like__FJ411172
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacugguccaacuacgaccccaccgaggagauccccgccccccucggcacccccgacuucgucggcaagauccagggcaugcucacccagaccacccgccgcgacggcuccacccgcggccacaaggccaccguccucaccggcuccgccgacuucgcccccaagcucggccgcguccaguucgccaccgacaccgacaacgacuucgaguccggcgagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16243 - RNA, 1617 nt, Artificial Sequence
  derived and/or modified sequence opt2 from VP1__Norovirus_and/or_Norovirus-like__AB447449
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccacuucuacacccucgcccccaugggcaacggcaccggccgccgccgcuga

SEQ ID NO: 16244 - RNA, 1617 nt, Artificial Sequence
  derived and/or modified sequence opt2 from VP1__Norovirus_and/or_Norovirus-like__AB447431
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcuga

SEQ ID NO: 16245 - RNA, 1617 nt, Artificial Sequence
  derived and/or modified sequence opt2 from VP1__Norovirus_and/or_Norovirus-like__EU078415
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccuccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcaacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16246 - RNA, 1617 nt, Artificial Sequence
  derived and/or modified sequence opt2 from VP1__Norovirus_and/or_Norovirus-like__AB385643
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16247 - RNA, 1617 nt, Artificial Sequence
  derived and/or modified sequence opt2 from VP1__Norovirus_and/or_Norovirus-like__AB385636
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgacuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgaccucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16248 - RNA, 1617 nt, Artificial Sequence
  derived and/or modified sequence opt2 from VP1__Norovirus_and/or_Norovirus-like__AB385629
augaagauggccuccaacgacgccacccccuccgacggcuccaccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccaacacccagaacuacaccaugaaccucgccucccagaacuggaacaacuacgaccccaccgaggagauccccgccccccucggcacccccgacuucgucggccgcauccagggcguccucacccagaccacccgcggcgacggcuccacccgcggccacaaggccaccgucuccaccggcuccguccacuucacccccaagcucggcuccguccaguucuccaccgacaccuccaacgaccucgagaccggccagaacacccgcuucacccccgucggcgucguccaggacggcggcaccacccaccgcaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16249 - RNA, 1617 nt, Artificial Sequence
  derived and/or modified sequence opt2 from VP1__Norovirus_and/or_Norovirus-like__EU839586
augaagauggccuccaacgacgccucccccuccgacggcuccaccgccaaccucguccccgaggucaacaacgaggucauggcccucgagcccgucgucggcgccgccaucgccgcccccgucaccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16250 - RNA, 1617 nt, Artificial Sequence
  derived and/or modified sequence opt2 from VP1__Norovirus_and/or_Norovirus-like__EU310927
augaagauggccuccuccgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucaccaccgacaccaacaacgaccucgagaccggccagaacaccaaguucacccccgucggcgucguccaggacggcaacuccgcccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 16251 - RNA, 1617 nt, Artificial Sequence
  derived and/or modified sequence opt2 from VP1__Norovirus_and/or_Norovirus-like__AB294787
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16252 - RNA, 1617 nt, Artificial Sequence
  derived and/or modified sequence opt2 from VP1__Norovirus_and/or_Norovirus-like__AY587987
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcgccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16253 - RNA, 1617 nt, Artificial Sequence
  derived and/or modified sequence opt2 from VP1__Norovirus_and/or_Norovirus-like__AY502019
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16254 - RNA, 1617 nt, Artificial Sequence
  derived and/or modified sequence opt2 from VP1__Norovirus_and/or_Norovirus-like__LC177653
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16255 - RNA, 1617 nt, Artificial Sequence
  derived and/or modified sequence opt2 from VP1__Norovirus_and/or_Norovirus-like__AB972486
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16256 - RNA, 1617 nt, Artificial Sequence
  derived and/or modified sequence opt2 from VP1__Norovirus_and/or_Norovirus-like__KR904235
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccaccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16257 - RNA, 1617 nt, Artificial Sequence
  derived and/or modified sequence opt2 from VP1__Norovirus_and/or_Norovirus-like__AB933753
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16258 - RNA, 1617 nt, Artificial Sequence
  derived and/or modified sequence opt2 from VP1__Norovirus_and/or_Norovirus-like__AB933721
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16259 - RNA, 1617 nt, Artificial Sequence
  derived and/or modified sequence opt2 from VP1__Norovirus_and/or_Norovirus-like__AB933706
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggccuccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16260 - RNA, 1617 nt, Artificial Sequence
  derived and/or modified sequence opt2 from VP1__Norovirus_and/or_Norovirus-like__AB933669
augaagauggccuccaacgacgccaccgccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16261 - RNA, 1617 nt, Artificial Sequence
  derived and/or modified sequence opt2 from VP1__Norovirus_and/or_Norovirus-like__EU921350
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcagugggcccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16262 - RNA, 1617 nt, Artificial Sequence
  derived and/or modified sequence opt2 from VP1__Norovirus_and/or_Norovirus-like__LC005712
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16263 - RNA, 1617 nt, Artificial Sequence
  derived and/or modified sequence opt2 from VP1__Norovirus_and/or_Norovirus-like__LC018707
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucucccccaagcucggccgcguccaguucgagaccgacaccgaccacgacuucgaggucaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16264 - RNA, 1617 nt, Artificial Sequence
  derived and/or modified sequence opt2 from VP1__Norovirus_and/or_Norovirus-like__KM982955
augaagauggccuccuccgacgccacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16265 - RNA, 1617 nt, Artificial Sequence
  derived and/or modified sequence opt2 from VP1__Norovirus_and/or_Norovirus-like__KM982949
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucggcaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16266 - RNA, 1617 nt, Artificial Sequence
  derived and/or modified sequence opt2 from VP1__Norovirus_and/or_Norovirus-like__KM406485
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16267 - RNA, 1617 nt, Artificial Sequence
  derived and/or modified sequence opt2 from VP1__Norovirus_and/or_Norovirus-like__KM198574
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16268 - RNA, 1617 nt, Artificial Sequence
  derived and/or modified sequence opt2 from VP1__Norovirus_and/or_Norovirus-like__KM198517
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaucaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacauccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16269 - RNA, 1617 nt, Artificial Sequence
  derived and/or modified sequence opt2 from VP1__Norovirus_and/or_Norovirus-like__JX439839
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16270 - RNA, 1617 nt, Artificial Sequence
  derived and/or modified sequence opt2 from VP1__Norovirus_and/or_Norovirus-like__JX439837
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16271 - RNA, 1617 nt, Artificial Sequence
  derived and/or modified sequence opt2 from VP1__Norovirus_and/or_Norovirus-like__KC631815
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16272 - RNA, 1617 nt, Artificial Sequence
  derived and/or modified sequence opt2 from VP1__Norovirus_and/or_Norovirus-like__KC409315
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgaggacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16273 - RNA, 1617 nt, Artificial Sequence
  derived and/or modified sequence opt2 from VP1__Norovirus_and/or_Norovirus-like__KC409289
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16274 - RNA, 1617 nt, Artificial Sequence
  derived and/or modified sequence opt2 from VP1__Norovirus_and/or_Norovirus-like__KC409278
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16275 - RNA, 1617 nt, Artificial Sequence
  derived and/or modified sequence opt2 from VP1__Norovirus_and/or_Norovirus-like__KC175402
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16276 - RNA, 1617 nt, Artificial Sequence
  derived and/or modified sequence opt2 from VP1__Norovirus_and/or_Norovirus-like__JX459616
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16277 - RNA, 1617 nt, Artificial Sequence
  derived and/or modified sequence opt2 from VP1__Norovirus_and/or_Norovirus-like__JX459599
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucaccaacaucgccggcucccagaccuacaccaugaaccucgccucccagaacuggaacaacuacgaccccaccgaggagauccccgccccccucggcacccccgacuucgucggccgcauccagggcguccucacccagaccacccgcggcgacggcuccacccgcggccacaaggccaccgucuccaccggcuccgccuacuucacccccaagcucggcuccguccaguucuccaccgacaccuccaccgacuucgagaccggccagaacacccgcuucacccccgucggcgucguccaggacggcuccaccacccacaagaacgagccccagcaguggguccuccccuccuacuccggccgcgacucccacaacguccaccucgcccccgccgucgcccccaccuuccccggcgagcagauccucuucuuccgcuccaccaugcccggcugcuccggcuaccccaacauggaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16278 - RNA, 1617 nt, Artificial Sequence
  derived and/or modified sequence opt2 from VP1__Norovirus_and/or_Norovirus-like__JN400603
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaucaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16279 - RNA, 1617 nt, Artificial Sequence
  derived and/or modified sequence opt2 from VP1__Norovirus_and/or_Norovirus-like__JQ613572
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagacccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccacccagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcuccaccacccaccgcaacgagccccagcagugggcccuccccuccuacuccggccgcuccgcccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16280 - RNA, 1617 nt, Artificial Sequence
  derived and/or modified sequence opt2 from VP1__Norovirus_and/or_Norovirus-like__JQ613525
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16281 - RNA, 1617 nt, Artificial Sequence
  derived and/or modified sequence opt2 from VP1__Norovirus_and/or_Norovirus-like__JQ613510
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacgccaugaaccucgccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16282 - RNA, 1617 nt, Artificial Sequence
  derived and/or modified sequence opt2 from VP1__Norovirus_and/or_Norovirus-like__GQ856450
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuccaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16283 - RNA, 1617 nt, Artificial Sequence
  derived and/or modified sequence opt2 from VP1__Norovirus_and/or_Norovirus-like__AB541296
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucauccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16284 - RNA, 1617 nt, Artificial Sequence
  derived and/or modified sequence opt2 from VP1__Norovirus_and/or_Norovirus-like__AB541212
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16285 - RNA, 1617 nt, Artificial Sequence
  derived and/or modified sequence opt2 from VP1__Norovirus_and/or_Norovirus-like__AB504321
augaagauggccuccaacgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16286 - RNA, 1617 nt, Artificial Sequence
  derived and/or modified sequence opt2 from VP1__Norovirus_and/or_Norovirus-like__AB294785
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16287 - RNA, 1617 nt, Artificial Sequence
  derived and/or modified sequence opt2 from VP1__Norovirus_and/or_Norovirus-like__AB294780
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccaccaagggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16288 - RNA, 1617 nt, Artificial Sequence
  derived and/or modified sequence opt2 from VP1__Norovirus_and/or_Norovirus-like__AB303933
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuaccucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16289 - RNA, 1617 nt, Artificial Sequence
  derived and/or modified sequence opt2 from VP1__Norovirus_and/or_Norovirus-like__AY587988
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcgccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16290 - RNA, 1617 nt, Artificial Sequence
  derived and/or modified sequence opt2 from VP1__Norovirus_and/or_Norovirus-like__KX354103
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgaguucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16291 - RNA, 1617 nt, Artificial Sequence
  derived and/or modified sequence opt2 from VP1__Norovirus_and/or_Norovirus-like__KX354048
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacaccgaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16292 - RNA, 1617 nt, Artificial Sequence
  derived and/or modified sequence opt2 from VP1__Norovirus_and/or_Norovirus-like__KX354047
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16293 - RNA, 1617 nt, Artificial Sequence
  derived and/or modified sequence opt2 from VP1__Norovirus_and/or_Norovirus-like__KU985161
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgccaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16294 - RNA, 1617 nt, Artificial Sequence
  derived and/or modified sequence opt2 from VP1__Norovirus_and/or_Norovirus-like__AB972517
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16295 - RNA, 1617 nt, Artificial Sequence
  derived and/or modified sequence opt2 from VP1__Norovirus_and/or_Norovirus-like__AB972494
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16296 - RNA, 1617 nt, Artificial Sequence
  derived and/or modified sequence opt2 from VP1__Norovirus_and/or_Norovirus-like__KU311163
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccagaucgccuccacccagaccuacaccaugaaccucgccucccucaacuggaacaacuacgaccccaccgaggagauccccgccccccucggcgcccccgacuucaugggcaagauccagggcguccucacccagaccacccgccaggacggcuccacccgcggccacaaggccaccgucuccaccggcuccguccacuucacccccaagcucggcuccguccgcuucgacaccgacaccaacaacaaccuccagccccaccaguccacccgcuucacccccgucggcgucauccaggacggcgacacccaccagaacgagccccagcaguggguccuccccugcuacuccggccgcgacgucaacaacguccaccucgcccccgccgucgcccccuccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacaaccucgucaucccccccaacggcuacuuccgcuucgacuccugggucaaccaguucuacacccucgcccccaugggcaacggcaccggccgccgccgcgucuga

SEQ ID NO: 16297 - RNA, 1617 nt, Artificial Sequence
  derived and/or modified sequence opt2 from VP1__Norovirus_and/or_Norovirus-like__KR904236
augaagauggccuccuccgacgccaacuccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccaccaagaccgacggcuccacccgcggccacaaggccaccgucuacaccggcuccgccgacuucgcccccaagcucggccgcguccaguucgccaccgacaccgacaacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 16298 - RNA, 1617 nt, Artificial Sequence
  derived and/or modified sequence opt2 from VP1__Norovirus_and/or_Norovirus-like__KR904225
augaagauggccuccuccgacgccaaccccuccgagggcuccaccgccucccucguccccgaggucaacaacgaggucauggcccucgagcccgucgccggcgccgccaucgccgcccccgucgccggccaggucaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgagcccaccaucaagcucgucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccuccuucgucguccagccccagaacggccgcugcaccaccgacggcguccuccucggcaccacccagcucucccccgucaacaucugcaccuuccgcggcgacgucacccacaucuccggcucccgcaaccacaccaugaaccucgccucccagaacuggaacuccuacgaccccaccgaggagauccccgccccccucggcacccccgacuucgucggcaagauccagggcguccucacccagaccacccgcuccgacggcuccacccgcggccacaaggccaccgucuacaccggcuccgccgacuucucccccaagcucggccgcauccaguucgccaccgacaccgacaacgacuucgagaccaaccagaacaccaaguucacccccgucggcgucauccaggacggcggcaccacccaccgcaacgagccccagcaguggguccuccccaccuacuccggccgcaacacccacaacguccaccucgcccccgccgucgcccccaccuuccccggcgagcagcuccucuucuuccgcuccaccaugcccggcugcuccggcuaccccgacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuucacccucgcccccaugggcaacggcaccggccgccgccgcuga

SEQ ID NO: 16299 - RNA, 1617 nt, Artificial Sequence
  derived and/or modified sequence opt2 from VP1__Norovirus_and/or_Norovirus-like__LC005710
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccacccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16300 - RNA, 1617 nt, Artificial Sequence
  derived and/or modified sequence opt2 from VP1__Norovirus_and/or_Norovirus-like__LC018709
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccggcgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucggcaccgacaccgaccacgaccucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16301 - RNA, 1617 nt, Artificial Sequence
  derived and/or modified sequence opt2 from VP1__Norovirus_and/or_Norovirus-like__KM198587
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16302 - RNA, 1617 nt, Artificial Sequence
  derived and/or modified sequence opt2 from VP1__Norovirus_and/or_Norovirus-like__KM198560
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16303 - RNA, 1617 nt, Artificial Sequence
  derived and/or modified sequence opt2 from VP1__Norovirus_and/or_Norovirus-like__KM198521
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcgccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16304 - RNA, 1617 nt, Artificial Sequence
  derived and/or modified sequence opt2 from VP1__Norovirus_and/or_Norovirus-like__KM198490
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacaucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagcgcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16305 - RNA, 1617 nt, Artificial Sequence
  derived and/or modified sequence opt2 from VP1__Norovirus_and/or_Norovirus-like__KC409241
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16306 - RNA, 1617 nt, Artificial Sequence
  derived and/or modified sequence opt2 from VP1__Norovirus_and/or_Norovirus-like__JX459625
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16307 - RNA, 1617 nt, Artificial Sequence
  derived and/or modified sequence opt2 from VP1__Norovirus_and/or_Norovirus-like__JX459613
augaagauggccuccaacgacgcccaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16308 - RNA, 1617 nt, Artificial Sequence
  derived and/or modified sequence opt2 from VP1__Norovirus_and/or_Norovirus-like__JX459600
augaagauggccuccaacgacgccaaccccuccgacggcuccgccgcccaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16309 - RNA, 1617 nt, Artificial Sequence
  derived and/or modified sequence opt2 from VP1__Norovirus_and/or_Norovirus-like__JX459596
augaagauggccuccaacgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16310 - RNA, 1617 nt, Artificial Sequence
  derived and/or modified sequence opt2 from VP1__Norovirus_and/or_Norovirus-like__JX155749
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16311 - RNA, 1617 nt, Artificial Sequence
  derived and/or modified sequence opt2 from VP1__Norovirus_and/or_Norovirus-like__JQ613511
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16312 - RNA, 1617 nt, Artificial Sequence
  derived and/or modified sequence opt2 from VP1__Norovirus_and/or_Norovirus-like__HM802547
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16313 - RNA, 1617 nt, Artificial Sequence
  derived and/or modified sequence opt2 from VP1__Norovirus_and/or_Norovirus-like__HM802544
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16314 - RNA, 1617 nt, Artificial Sequence
  derived and/or modified sequence opt2 from VP1__Norovirus_and/or_Norovirus-like__GQ856456
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucggcguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuucaagggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16315 - RNA, 1617 nt, Artificial Sequence
  derived and/or modified sequence opt2 from VP1__Norovirus_and/or_Norovirus-like__AB541332
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccgcccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16316 - RNA, 1617 nt, Artificial Sequence
  derived and/or modified sequence opt2 from VP1__Norovirus_and/or_Norovirus-like__AB541316
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccauggaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16317 - RNA, 1617 nt, Artificial Sequence
  derived and/or modified sequence opt2 from VP1__Norovirus_and/or_Norovirus-like__AB541238
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16318 - RNA, 1617 nt, Artificial Sequence
  derived and/or modified sequence opt2 from VP1__Norovirus_and/or_Norovirus-like__AB535750
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucggccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccgcaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16319 - RNA, 1617 nt, Artificial Sequence
  derived and/or modified sequence opt2 from VP1__Norovirus_and/or_Norovirus-like__FJ538900
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccgccgaggagauccccgccccccucggcacccccgacuucgucggccgcauccagggcguccucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16320 - RNA, 1617 nt, Artificial Sequence
  derived and/or modified sequence opt2 from VP1__Norovirus_and/or_Norovirus-like__EU876889
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16321 - RNA, 1617 nt, Artificial Sequence
  derived and/or modified sequence opt2 from VP1__Norovirus_and/or_Norovirus-like__EU876887
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccuccuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16322 - RNA, 1617 nt, Artificial Sequence
  derived and/or modified sequence opt2 from VP1__Norovirus_and/or_Norovirus-like__FJ411171
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacugguccaacuacgaccccaccgaggagauccccgccccccucggcacccccgacuucgucggcaagauccagggcaugcucacccagaccacccgccgcgacggcuccacccgcggccacaaggccaccguccucaccggcuccgccgacuucgcccccaagcucggccgcguccaguucgccaccgacaccgacaacgacuucgaguccggcgagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16323 - RNA, 1617 nt, Artificial Sequence
  derived and/or modified sequence opt2 from VP1__Norovirus_and/or_Norovirus-like__AB447460
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacuccuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16324 - RNA, 1617 nt, Artificial Sequence
  derived and/or modified sequence opt2 from VP1__Norovirus_and/or_Norovirus-like__AB447454
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16325 - RNA, 1617 nt, Artificial Sequence
  derived and/or modified sequence opt2 from VP1__Norovirus_and/or_Norovirus-like__AB447443
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagcuccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16326 - RNA, 1617 nt, Artificial Sequence
  derived and/or modified sequence opt2 from VP1__Norovirus_and/or_Norovirus-like__AB447430
augaagauggccuccaacgacgccaaccccuccgacggcuccaccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccaaggucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16327 - RNA, 1617 nt, Artificial Sequence
  derived and/or modified sequence opt2 from VP1__Norovirus_and/or_Norovirus-like__EU078420
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuuccaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16328 - RNA, 1617 nt, Artificial Sequence
  derived and/or modified sequence opt2 from VP1__Norovirus_and/or_Norovirus-like__AB385637
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16329 - RNA, 1617 nt, Artificial Sequence
  derived and/or modified sequence opt2 from VP1__Norovirus_and/or_Norovirus-like__EF202568
augaagauggccuccaacgacgccacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccuccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccaccccccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16330 - RNA, 1617 nt, Artificial Sequence
  derived and/or modified sequence opt2 from VP1__Norovirus_and/or_Norovirus-like__AB294781
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccaccaagggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16331 - RNA, 1617 nt, Artificial Sequence
  derived and/or modified sequence opt2 from VP1__Norovirus_and/or_Norovirus-like__AB303940
augaagauggccuccaacgacgccacccccuccgacggcuccaccgccaaccucguccccgaggucaacaccgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcaccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccauccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16332 - RNA, 1617 nt, Artificial Sequence
  derived and/or modified sequence opt2 from VP1__Norovirus_and/or_Norovirus-like__DQ415279
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacgucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16333 - RNA, 1617 nt, Artificial Sequence
  derived and/or modified sequence opt2 from VP1__Norovirus_and/or_Norovirus-like__DQ078794
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagguccucucccccucccaggucaccauguucccccacaucaucgucgacguccgccagcucgagcccguccucaucccccuccccgacguccgcaacaaccucuaccacuacaaccaguccaacgaccccaccauccgccucaucgccaugcucuacaccccccuccgcgccaacaacgccggcgacgacgucuucaccgucuccugccgcguccucacccgccccucccccgacuucgacuucauguuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcgcccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccuggaucaaccaguucuacacccucgcccccaugggcaacggcgccggccgccgccgcuga

SEQ ID NO: 16334 - RNA, 1617 nt, Artificial Sequence
  derived and/or modified sequence opt2 from VP1__Norovirus_and/or_Norovirus-like__KP784691
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcgacgcccacuucacccccaagcucggcuccgucauguucuccaccgacaccaacaacgacuucgagaccggccagaacacccgcuucacccccgucggcgucguccaggacggcuccaccacccaccagaacgagccccagcaguggguccuccccuccuaccucggccgcgacucccacaacguccaccucgcccccgccgucgcccccuccuuccccggcgagcagcuccucuucuuccgcuccaccaugcccggcugcuccggcuaccccaacaugaacauggacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16335 - RNA, 1617 nt, Artificial Sequence
  derived and/or modified sequence opt2 from VP1__Norovirus_and/or_Norovirus-like__KX907727
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaucgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16336 - RNA, 1617 nt, Artificial Sequence
  derived and/or modified sequence opt2 from VP1__Norovirus_and/or_Norovirus-like__KX354049
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16337 - RNA, 1617 nt, Artificial Sequence
  derived and/or modified sequence opt2 from VP1__Norovirus_and/or_Norovirus-like__KX354024
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16338 - RNA, 1617 nt, Artificial Sequence
  derived and/or modified sequence opt2 from VP1__Norovirus_and/or_Norovirus-like__KX353955
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16339 - RNA, 1617 nt, Artificial Sequence
  derived and/or modified sequence opt2 from VP1__Norovirus_and/or_Norovirus-like__AB972518
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaccacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16340 - RNA, 1617 nt, Artificial Sequence
  derived and/or modified sequence opt2 from VP1__Norovirus_and/or_Norovirus-like__AB933744
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16341 - RNA, 1617 nt, Artificial Sequence
  derived and/or modified sequence opt2 from VP1__Norovirus_and/or_Norovirus-like__AB933673
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggccagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16342 - RNA, 1617 nt, Artificial Sequence
  derived and/or modified sequence opt2 from VP1__Norovirus_and/or_Norovirus-like__KM245070
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16343 - RNA, 1617 nt, Artificial Sequence
  derived and/or modified sequence opt2 from VP1__Norovirus_and/or_Norovirus-like__EU921382
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16344 - RNA, 1617 nt, Artificial Sequence
  derived and/or modified sequence opt2 from VP1__Norovirus_and/or_Norovirus-like__KP293589
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggacauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16345 - RNA, 1617 nt, Artificial Sequence
  derived and/or modified sequence opt2 from VP1__Norovirus_and/or_Norovirus-like__KP241908
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16346 - RNA, 1617 nt, Artificial Sequence
  derived and/or modified sequence opt2 from VP1__Norovirus_and/or_Norovirus-like__KJ451059
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16347 - RNA, 1617 nt, Artificial Sequence
  derived and/or modified sequence opt2 from VP1__Norovirus_and/or_Norovirus-like__KM198570
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggggcgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaacggccagcacgaccucgucaucccccccaacggcuacuuccgcuucgacuccugggucaaccaguucuacacccucgcccccaugggcaacggcaccggccgccgccgcuga

SEQ ID NO: 16348 - RNA, 1617 nt, Artificial Sequence
  derived and/or modified sequence opt2 from VP1__Norovirus_and/or_Norovirus-like__KM198558
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgcccccuucgcccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16349 - RNA, 1617 nt, Artificial Sequence
  derived and/or modified sequence opt2 from VP1__Norovirus_and/or_Norovirus-like__AB447456
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16350 - RNA, 1617 nt, Artificial Sequence
  derived and/or modified sequence opt2 from VP1__Norovirus_and/or_Norovirus-like__KF177444
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucaucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16351 - RNA, 1617 nt, Artificial Sequence
  derived and/or modified sequence opt2 from VP1__Norovirus_and/or_Norovirus-like__KF429776
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16352 - RNA, 1617 nt, Artificial Sequence
  derived and/or modified sequence opt2 from VP1__Norovirus_and/or_Norovirus-like__KC243078
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgaggucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcuga

SEQ ID NO: 16353 - RNA, 1617 nt, Artificial Sequence
  derived and/or modified sequence opt2 from VP1__Norovirus_and/or_Norovirus-like__KC409280
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagauccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16354 - RNA, 1617 nt, Artificial Sequence
  derived and/or modified sequence opt2 from VP1__Norovirus_and/or_Norovirus-like__KC175357
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16355 - RNA, 1617 nt, Artificial Sequence
  derived and/or modified sequence opt2 from VP1__Norovirus_and/or_Norovirus-like__JX459621
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucgcccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16356 - RNA, 1617 nt, Artificial Sequence
  derived and/or modified sequence opt2 from VP1__Norovirus_and/or_Norovirus-like__JQ613541
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgucgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaucggccagcacgaccucgucaucccccccaacggcuacuuccgcuucgacuccugggucaaccaguucuacacccucgcccccaugggcaacggcaccggccgccgccgcuga

SEQ ID NO: 16357 - RNA, 1617 nt, Artificial Sequence
  derived and/or modified sequence opt2 from VP1__Norovirus_and/or_Norovirus-like__JQ613527
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggguccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccaccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16358 - RNA, 1617 nt, Artificial Sequence
  derived and/or modified sequence opt2 from VP1__Norovirus_and/or_Norovirus-like__JF827296
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgucuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgccccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccauccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16359 - RNA, 1617 nt, Artificial Sequence
  derived and/or modified sequence opt2 from VP1__Norovirus_and/or_Norovirus-like__JF713050
augaagauggccuccaacgacgccaaccccuccgacggcuccgccgccaaccucguccccgaggucaacaacgaggucauggcccucgagcccgucgccggcgccgcccucgccgcccccgucgccggccagcagaacgucaucgaccccuggauccgcaacaacuucguccaggcccccggcggcgaguucaccgucuccccccgcaacgcccccggcgagauccucugguccgccccccucucccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgagcccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccuccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccuccaucaacuggaacaacuacgaccccaccgaggagauccccgccccccucggcacccccgacuucgucggcaagauccagggcaugcucacccagaccacccgcggcgacggcuccacccgcggccaccgcgccaccgucuacaccggcuccgcccccuucacccccaagcucggcuccguccaguucaccaccgacaccgacaacgacuucgagaccaaccagaacaccaaguucacccccgucggcgucguccaggacggcgacaccgcccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16360 - RNA, 1617 nt, Artificial Sequence
  derived and/or modified sequence opt2 from VP1__Norovirus_and/or_Norovirus-like__HM802548
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcuccuaccgcaugaaccucgccucccagaacuggaacaacuacgaccccaccgaggagauccccgccccccucggcacccccgacuucgucggcaagauccagggcaugcucacccagaccaccaagcgcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16361 - RNA, 1617 nt, Artificial Sequence
  derived and/or modified sequence opt2 from VP1__Norovirus_and/or_Norovirus-like__GQ856459
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaugauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacggccucgucaucccccccaacggcuacuuccgcuucgacuccugggucaaccaguucuacacccucgcccccaugggcaacggcaccggccgccgccgcuga

SEQ ID NO: 16362 - RNA, 1617 nt, Artificial Sequence
  derived and/or modified sequence opt2 from VP1__Norovirus_and/or_Norovirus-like__AB541308
augaagauggccuccaacgacgccaaccccuccgacggcuccgccgccaaccucguccccgaggucaacaacgaggucauggcccucgaccccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucugccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16363 - RNA, 1617 nt, Artificial Sequence
  derived and/or modified sequence opt2 from VP1__Norovirus_and/or_Norovirus-like__AB541276
augaagauggccuccaacgacgccaaccccuccgacggcuccgccgccucccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16364 - RNA, 1617 nt, Artificial Sequence
  derived and/or modified sequence opt2 from VP1__Norovirus_and/or_Norovirus-like__AB541224
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16365 - RNA, 1617 nt, Artificial Sequence
  derived and/or modified sequence opt2 from VP1__Norovirus_and/or_Norovirus-like__AB504330
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccucaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16366 - RNA, 1617 nt, Artificial Sequence
  derived and/or modified sequence opt2 from VP1__Norovirus_and/or_Norovirus-like__AB447445
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgacggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16367 - RNA, 1617 nt, Artificial Sequence
  derived and/or modified sequence opt2 from VP1__Norovirus_and/or_Norovirus-like__AB294793
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16368 - RNA, 1617 nt, Artificial Sequence
  derived and/or modified sequence opt2 from VP1__Norovirus_and/or_Norovirus-like__AB303934
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucauccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16369 - RNA, 1617 nt, Artificial Sequence
  derived and/or modified sequence opt2 from VP1__Norovirus_and/or_Norovirus-like__KU678205
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagguccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16370 - RNA, 1617 nt, Artificial Sequence
  derived and/or modified sequence opt2 from VP1__Norovirus_and/or_Norovirus-like__LC177657
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccucguccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16371 - RNA, 1617 nt, Artificial Sequence
  derived and/or modified sequence opt2 from VP1__Norovirus_and/or_Norovirus-like__LC177656
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaacugguccaacuacgaccccaccgaggagauccccgccccccucggcacccccgacuucgucggcaagauccagggcguccucacccagaccacccgcaucgacggcuccacccgcggccacaaggccaccgucuacaccggcuccgccgacuucgcccccaagcucggccgcguccaguucgagaccgacaccgaccacgacuucgaggccaaccaguccaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16372 - RNA, 1617 nt, Artificial Sequence
  derived and/or modified sequence opt2 from VP1__Norovirus_and/or_Norovirus-like__KX354136
augaagauggccuccuccgacgccaaccccuccgacggcuccgccgccaaccucguccccgaggucuccaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcuccgacggcuccacccgcggccacaaggccaccgucuacaccggcuccgccgacuucgcccccaagcucggccgcguccaguucgagaccgacaccgaccgcgacuucgagaccaaccagaacaccaaguucacccccgucggcgucauccaggacggcaccaccgcccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16373 - RNA, 1617 nt, Artificial Sequence
  derived and/or modified sequence opt2 from VP1__Norovirus_and/or_Norovirus-like__KX354121
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacaucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgaguucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16374 - RNA, 1617 nt, Artificial Sequence
  derived and/or modified sequence opt2 from VP1__Norovirus_and/or_Norovirus-like__KX354110
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccaccuccaccgacggcuccacccgcggccacaaggccaccgucuacaccggcuccgccgaguucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16375 - RNA, 1617 nt, Artificial Sequence
  derived and/or modified sequence opt2 from VP1__Norovirus_and/or_Norovirus-like__KX354107
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16376 - RNA, 1617 nt, Artificial Sequence
  derived and/or modified sequence opt2 from VP1__Norovirus_and/or_Norovirus-like__KX353991
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcauccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16377 - RNA, 1617 nt, Artificial Sequence
  derived and/or modified sequence opt2 from VP1__Norovirus_and/or_Norovirus-like__KU985162
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16378 - RNA, 1617 nt, Artificial Sequence
  derived and/or modified sequence opt2 from VP1__Norovirus_and/or_Norovirus-like__AB972476
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16379 - RNA, 1617 nt, Artificial Sequence
  derived and/or modified sequence opt2 from VP1__Norovirus_and/or_Norovirus-like__KU311162
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccagaucgccuccacccagaccuacaccaugaaccucgccucccucaacuggaacaacuacgaccccaccgaggagauccccgccccccucggcgcccccgacuucaugggcaagauccagggcguccucacccagaccacccgccagggcggcuccacccgcggccacaaggccaccgucuccaccggcuccguccacuucacccccaagcucggcuccguccgcuucgacaccgacaccaacaacgaccuccagccccaccaguccacccgcuucacccccgucggcgucauccaggacggcgacacccaccagaacgagccccagcagugggcccuccccugcuacuccggccgcgacgucaacaacguccaccucgcccccgccgucgcccccuccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacaaccucgucaucccccccaacggcuacuuccgcuucgacuccugggucaaccaguucuacacccucgcccccaugggcaacggcaccggccgccgccgcgucuga

SEQ ID NO: 16380 - RNA, 1617 nt, Artificial Sequence
  derived and/or modified sequence opt2 from VP1__Norovirus_and/or_Norovirus-like__KR904212
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaccuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuucaccggcuccgccgacuucucccccaagcucggccgcguccaguucgccaccgacaccgacaacgacuucgucgccaaccagaacaccaaguucacccccgucggcgucauccaggacggcggcaccgcccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16381 - RNA, 1617 nt, Artificial Sequence
  derived and/or modified sequence opt2 from VP1__Norovirus_and/or_Norovirus-like__AB933678
augaagauggccuccaacgacgccaaccccuucgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccgccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16382 - RNA, 1617 nt, Artificial Sequence
  derived and/or modified sequence opt2 from VP1__Norovirus_and/or_Norovirus-like__AB933648
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16383 - RNA, 1617 nt, Artificial Sequence
  derived and/or modified sequence opt2 from VP1__Norovirus_and/or_Norovirus-like__LN854571
augaagauggccuccaacgacgccgcccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16384 - RNA, 1617 nt, Artificial Sequence
  derived and/or modified sequence opt2 from VP1__Norovirus_and/or_Norovirus-like__EU921384
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16385 - RNA, 1617 nt, Artificial Sequence
  derived and/or modified sequence opt2 from VP1__Norovirus_and/or_Norovirus-like__LC005716
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcuccggcaacuacaccaugaaccucgccuccgucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16386 - RNA, 1617 nt, Artificial Sequence
  derived and/or modified sequence opt2 from VP1__Norovirus_and/or_Norovirus-like__KP241914
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacgcccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16387 - RNA, 1617 nt, Artificial Sequence
  derived and/or modified sequence opt2 from VP1__Norovirus_and/or_Norovirus-like__KJ433968
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccccggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcuccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16388 - RNA, 1617 nt, Artificial Sequence
  derived and/or modified sequence opt2 from VP1__Norovirus_and/or_Norovirus-like__KP176409
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16389 - RNA, 1617 nt, Artificial Sequence
  derived and/or modified sequence opt2 from VP1__Norovirus_and/or_Norovirus-like__KM514064
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccuccgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16390 - RNA, 1617 nt, Artificial Sequence
  derived and/or modified sequence opt2 from VP1__Norovirus_and/or_Norovirus-like__KJ649703
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcauccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16391 - RNA, 1617 nt, Artificial Sequence
  derived and/or modified sequence opt2 from VP1__Norovirus_and/or_Norovirus-like__KF177447
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaucaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16392 - RNA, 1617 nt, Artificial Sequence
  derived and/or modified sequence opt2 from VP1__Norovirus_and/or_Norovirus-like__JX439820
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccuccucccgcaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgacaccgacaccgacaacgacuucgagaccaaccagaacaccaaguucacccccgucggcgucauccaggacggcuccaccaccuaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16393 - RNA, 1617 nt, Artificial Sequence
  derived and/or modified sequence opt2 from VP1__Norovirus_and/or_Norovirus-like__HF952120
augaagauggccuccuccgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucgucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgaggccaaccagaacaccaaguucacccccgucggcgucauccaggacggcuccaccgcccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16394 - RNA, 1617 nt, Artificial Sequence
  derived and/or modified sequence opt2 from VP1__Norovirus_and/or_Norovirus-like__KC517369
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccaccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16395 - RNA, 1617 nt, Artificial Sequence
  derived and/or modified sequence opt2 from VP1__Norovirus_and/or_Norovirus-like__KC409293
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16396 - RNA, 1617 nt, Artificial Sequence
  derived and/or modified sequence opt2 from VP1__Norovirus_and/or_Norovirus-like__JX984951
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcggcaccacccaccgcaacgagccccagcaguggguccuccccaacuacuccggcuccgacguccccaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16397 - RNA, 1617 nt, Artificial Sequence
  derived and/or modified sequence opt2 from VP1__Norovirus_and/or_Norovirus-like__JX459612
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccaccucccgcgacggcuccacccgcggccacaaggccaccgucuccaccggcuccguccacuucacccccaagcucggccgcguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16398 - RNA, 1617 nt, Artificial Sequence
  derived and/or modified sequence opt2 from VP1__Norovirus_and/or_Norovirus-like__JX459604
augaagauggccuccaacgacgucacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16399 - RNA, 1617 nt, Artificial Sequence
  derived and/or modified sequence opt2 from VP1__Norovirus_and/or_Norovirus-like__JX155745
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgcccccuucacccccaagaugggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16400 - RNA, 1617 nt, Artificial Sequence
  derived and/or modified sequence opt2 from VP1__Norovirus_and/or_Norovirus-like__HM635155
augaagauggccuccuccgacaccaagaccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaucgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16401 - RNA, 1617 nt, Artificial Sequence
  derived and/or modified sequence opt2 from VP1__Norovirus_and/or_Norovirus-like__JN400620
augaagauggccuccaacgacgucaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16402 - RNA, 1617 nt, Artificial Sequence
  derived and/or modified sequence opt2 from VP1__Norovirus_and/or_Norovirus-like__JQ613573
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccuccucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16403 - RNA, 1617 nt, Artificial Sequence
  derived and/or modified sequence opt2 from VP1__Norovirus_and/or_Norovirus-like__JQ478408
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16404 - RNA, 1617 nt, Artificial Sequence
  derived and/or modified sequence opt2 from VP1__Norovirus_and/or_Norovirus-like__EF684915
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaaguggaacaaguacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucuccaccgacaccgagaacgacuucgagacccaccagaacaccaaguucacccccgucggcgucacccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16405 - RNA, 1617 nt, Artificial Sequence
  derived and/or modified sequence opt2 from VP1__Norovirus_and/or_Norovirus-like__HQ456331
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagacccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16406 - RNA, 1617 nt, Artificial Sequence
  derived and/or modified sequence opt2 from VP1__Norovirus_and/or_Norovirus-like__HQ456322
augaagaucgccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccuccacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16407 - RNA, 1617 nt, Artificial Sequence
  derived and/or modified sequence opt2 from VP1__Norovirus_and/or_Norovirus-like__HM802551
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16408 - RNA, 1617 nt, Artificial Sequence
  derived and/or modified sequence opt2 from VP1__Norovirus_and/or_Norovirus-like__HM802546
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16409 - RNA, 1617 nt, Artificial Sequence
  derived and/or modified sequence opt2 from VP1__Norovirus_and/or_Norovirus-like__GQ856453
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcucccuccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16410 - RNA, 1617 nt, Artificial Sequence
  derived and/or modified sequence opt2 from VP1__Norovirus_and/or_Norovirus-like__GQ856445
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccaguccggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacgucgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16411 - RNA, 1617 nt, Artificial Sequence
  derived and/or modified sequence opt2 from VP1__Norovirus_and/or_Norovirus-like__AB541358
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccucauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagauccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcuga

SEQ ID NO: 16412 - RNA, 1617 nt, Artificial Sequence
  derived and/or modified sequence opt2 from VP1__Norovirus_and/or_Norovirus-like__AB541349
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcuccaccauccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16413 - RNA, 1617 nt, Artificial Sequence
  derived and/or modified sequence opt2 from VP1__Norovirus_and/or_Norovirus-like__AB541342
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgcccccuccggccccgaccucaaccccuaccucucccaccucgcccgcauguucaacgacuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16414 - RNA, 1617 nt, Artificial Sequence
  derived and/or modified sequence opt2 from VP1__Norovirus_and/or_Norovirus-like__AB541248
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16415 - RNA, 1617 nt, Artificial Sequence
  derived and/or modified sequence opt2 from VP1__Norovirus_and/or_Norovirus-like__GQ246798
augaagauggccuccuccgacgccaaccccuucgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16416 - RNA, 1617 nt, Artificial Sequence
  derived and/or modified sequence opt2 from VP1__Norovirus_and/or_Norovirus-like__GQ246791
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccgcaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccucaucccccaggacuggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16417 - RNA, 1617 nt, Artificial Sequence
  derived and/or modified sequence opt2 from VP1__Norovirus_and/or_Norovirus-like__GU350225
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16418 - RNA, 1617 nt, Artificial Sequence
  derived and/or modified sequence opt2 from VP1__Norovirus_and/or_Norovirus-like__AB504319
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggaggucaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16419 - RNA, 1617 nt, Artificial Sequence
  derived and/or modified sequence opt2 from VP1__Norovirus_and/or_Norovirus-like__AB447458
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16420 - RNA, 1617 nt, Artificial Sequence
  derived and/or modified sequence opt2 from VP1__Norovirus_and/or_Norovirus-like__AB385640
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacuccuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccacccccgucgagaagcucuucaccggccccuccuccgccuucaucguccagccccagaacggccgcugcaccaucgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagacccgccagaacacccgcuucacccccgucggcgucauccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcgucauguucgagugcaagcuccacaaguccggcuacaucaccgucgcccacaccggccagcacgaccucgucaucccccccaacggcuacuuccgcuucgacgccugggucaaccaguucuacacccucgcccccaugggcaacggcaccggccgccgccgcuga

SEQ ID NO: 16421 - RNA, 1617 nt, Artificial Sequence
  derived and/or modified sequence opt2 from VP1__Norovirus_and/or_Norovirus-like__AB385633
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuaccucggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16422 - RNA, 1617 nt, Artificial Sequence
  derived and/or modified sequence opt2 from VP1__Norovirus_and/or_Norovirus-like__DQ658413
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccgacacccacaacuacaccaugaaccucgccucccagaacuggaacaacuacgaccccaccgaggagauccccgccccccucggcacccccgacuucgucggcaagauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16423 - RNA, 1617 nt, Artificial Sequence
  derived and/or modified sequence opt2 from VP1__Norovirus_and/or_Norovirus-like__AB220923
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16424 - RNA, 1617 nt, Artificial Sequence
  derived and/or modified sequence opt2 from VP1__Norovirus_and/or_Norovirus-like__AY588016
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccgccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16425 - RNA, 1617 nt, Artificial Sequence
  derived and/or modified sequence opt2 from VP1__Norovirus_and/or_Norovirus-like__AY502022
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16426 - RNA, 1617 nt, Artificial Sequence
  derived and/or modified sequence opt2 from VP1__Norovirus_and/or_Norovirus-like__KX158280
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16427 - RNA, 1617 nt, Artificial Sequence
  derived and/or modified sequence opt2 from VP1__Norovirus_and/or_Norovirus-like__KX371606
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16428 - RNA, 1617 nt, Artificial Sequence
  derived and/or modified sequence opt2 from VP1__Norovirus_and/or_Norovirus-like__KX371605
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccaguccaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16429 - RNA, 1617 nt, Artificial Sequence
  derived and/or modified sequence opt2 from VP1__Norovirus_and/or_Norovirus-like__KX354128
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16430 - RNA, 1617 nt, Artificial Sequence
  derived and/or modified sequence opt2 from VP1__Norovirus_and/or_Norovirus-like__KX354099
augaagauggccuccuccgacgccucccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16431 - RNA, 1617 nt, Artificial Sequence
  derived and/or modified sequence opt2 from VP1__Norovirus_and/or_Norovirus-like__KX354087
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcucuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagauccaccagaacacccgcuucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcuga

SEQ ID NO: 16432 - RNA, 1617 nt, Artificial Sequence
  derived and/or modified sequence opt2 from VP1__Norovirus_and/or_Norovirus-like__KX354009
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16433 - RNA, 1617 nt, Artificial Sequence
  derived and/or modified sequence opt2 from VP1__Norovirus_and/or_Norovirus-like__KR131784
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaacauggccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16434 - RNA, 1617 nt, Artificial Sequence
  derived and/or modified sequence opt2 from VP1__Norovirus_and/or_Norovirus-like__AB972527
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcuacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16435 - RNA, 1617 nt, Artificial Sequence
  derived and/or modified sequence opt2 from VP1__Norovirus_and/or_Norovirus-like__AB972525
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccguccccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16436 - RNA, 1617 nt, Artificial Sequence
  derived and/or modified sequence opt2 from VP1__Norovirus_and/or_Norovirus-like__KT780388
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgccaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16437 - RNA, 1617 nt, Artificial Sequence
  derived and/or modified sequence opt2 from VP1__Norovirus_and/or_Norovirus-like__KT780373
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgccaccgacaccgaccacgacuucgucgccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16438 - RNA, 1617 nt, Artificial Sequence
  derived and/or modified sequence opt2 from VP1__Norovirus_and/or_Norovirus-like__AB933723
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccuccucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccgccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16439 - RNA, 1617 nt, Artificial Sequence
  derived and/or modified sequence opt2 from VP1__Norovirus_and/or_Norovirus-like__AB933708
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16440 - RNA, 1617 nt, Artificial Sequence
  derived and/or modified sequence opt2 from VP1__Norovirus_and/or_Norovirus-like__LC066046
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16441 - RNA, 1617 nt, Artificial Sequence
  derived and/or modified sequence opt2 from VP1__Norovirus_and/or_Norovirus-like__KJ678140
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacgucgucaucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16442 - RNA, 1617 nt, Artificial Sequence
  derived and/or modified sequence opt2 from VP1__Norovirus_and/or_Norovirus-like__KJ678139
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16443 - RNA, 1617 nt, Artificial Sequence
  derived and/or modified sequence opt2 from VP1__Norovirus_and/or_Norovirus-like__EU921383
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16444 - RNA, 1617 nt, Artificial Sequence
  derived and/or modified sequence opt2 from VP1__Norovirus_and/or_Norovirus-like__KP176405
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgagcucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16445 - RNA, 1617 nt, Artificial Sequence
  derived and/or modified sequence opt2 from VP1__Norovirus_and/or_Norovirus-like__KP176403
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacacccgcuucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16446 - RNA, 1617 nt, Artificial Sequence
  derived and/or modified sequence opt2 from VP1__Norovirus_and/or_Norovirus-like__KP096343
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16447 - RNA, 1617 nt, Artificial Sequence
  derived and/or modified sequence opt2 from VP1__Norovirus_and/or_Norovirus-like__KM268101
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcauccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16448 - RNA, 1617 nt, Artificial Sequence
  derived and/or modified sequence opt2 from VP1__Norovirus_and/or_Norovirus-like__KM198568
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcggcgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16449 - RNA, 1617 nt, Artificial Sequence
  derived and/or modified sequence opt2 from VP1__Norovirus_and/or_Norovirus-like__KM198532
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccgucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16450 - RNA, 1617 nt, Artificial Sequence
  derived and/or modified sequence opt2 from VP1__Norovirus_and/or_Norovirus-like__KM198527
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16451 - RNA, 1617 nt, Artificial Sequence
  derived and/or modified sequence opt2 from VP1__Norovirus_and/or_Norovirus-like__KF177448
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccuccgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16452 - RNA, 1617 nt, Artificial Sequence
  derived and/or modified sequence opt2 from VP1__Norovirus_and/or_Norovirus-like__KF008244
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16453 - RNA, 1617 nt, Artificial Sequence
  derived and/or modified sequence opt2 from VP1__Norovirus_and/or_Norovirus-like__KF060103
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16454 - RNA, 1617 nt, Artificial Sequence
  derived and/or modified sequence opt2 from VP1__Norovirus_and/or_Norovirus-like__KC960615
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagauccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16455 - RNA, 1617 nt, Artificial Sequence
  derived and/or modified sequence opt2 from VP1__Norovirus_and/or_Norovirus-like__KC517373
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacuccggcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagguccagggcguccucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccgcccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcgcgaccucgucaucccccccaacggcuacuuccgcuucgacuccugggucaaccaguucuacacccucgcccccaugggcaacggcaccggccgccgccgcuga

SEQ ID NO: 16456 - RNA, 1617 nt, Artificial Sequence
  derived and/or modified sequence opt2 from VP1__Norovirus_and/or_Norovirus-like__JX459615
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgaguucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16457 - RNA, 1617 nt, Artificial Sequence
  derived and/or modified sequence opt2 from VP1__Norovirus_and/or_Norovirus-like__JX459603
augaagauggccuccaacgacgccacccccuccgacggcgucgccgcccaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16458 - RNA, 1617 nt, Artificial Sequence
  derived and/or modified sequence opt2 from VP1__Norovirus_and/or_Norovirus-like__JX155746
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16459 - RNA, 1617 nt, Artificial Sequence
  derived and/or modified sequence opt2 from VP1__Norovirus_and/or_Norovirus-like__AB541333
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucgaccccgaccucaaccccuaccucucccagcucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16460 - RNA, 1617 nt, Artificial Sequence
  derived and/or modified sequence opt2 from VP1__Norovirus_and/or_Norovirus-like__AB541220
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcucuacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16461 - RNA, 1617 nt, Artificial Sequence
  derived and/or modified sequence opt2 from VP1__Norovirus_and/or_Norovirus-like__AB504312
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcgagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16462 - RNA, 1617 nt, Artificial Sequence
  derived and/or modified sequence opt2 from VP1__Norovirus_and/or_Norovirus-like__GQ849126
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16463 - RNA, 1617 nt, Artificial Sequence
  derived and/or modified sequence opt2 from VP1__Norovirus_and/or_Norovirus-like__AB447459
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcucaucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16464 - RNA, 1617 nt, Artificial Sequence
  derived and/or modified sequence opt2 from VP1__Norovirus_and/or_Norovirus-like__EU078413
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccagaacuggaacaacuacgaccccaccgaggagauccccgccccccucggcacccccgacuucgucggccgcauccagggcaugcucacccagaccacccgccgcgacggcuccacccgcggccacaaggccaccgucuccaccggcgacgcccacuucacccccaagcucggcuccaucauguucuccaccgacaccgacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16465 - RNA, 1617 nt, Artificial Sequence
  derived and/or modified sequence opt2 from VP1__Norovirus_and/or_Norovirus-like__EU078411
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16466 - RNA, 1617 nt, Artificial Sequence
  derived and/or modified sequence opt2 from VP1__Norovirus_and/or_Norovirus-like__AB385632
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagguccccgccccccucggcacccccgacuucaugggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucucccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16467 - RNA, 1617 nt, Artificial Sequence
  derived and/or modified sequence opt2 from VP1__Norovirus_and/or_Norovirus-like__EU839595
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccggcuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16468 - RNA, 1617 nt, Artificial Sequence
  derived and/or modified sequence opt2 from VP1__Norovirus_and/or_Norovirus-like__AB294788
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccaccacccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16469 - RNA, 1617 nt, Artificial Sequence
  derived and/or modified sequence opt2 from VP1__Norovirus_and/or_Norovirus-like__AB303936
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccuccuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccguccaguucgacaccgacaccaacuccgacuucgagaccggccagaacaccaaguucacccccgucggcgucguccaggacggcaacggcgcccaccagaacgagccccagcaguggguccuccccuccuacuccggccgcaccggccacaacgcccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16470 - RNA, 1617 nt, Artificial Sequence
  derived and/or modified sequence opt2 from VP1__Norovirus_and/or_Norovirus-like__AB303935
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccuccuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16471 - RNA, 1617 nt, Artificial Sequence
  derived and/or modified sequence opt2 from VP1__Norovirus_and/or_Norovirus-like__AY588018
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccguccaguucaacaccgacaccaacaacgacuucgagaccggccagaacaccaaguucacccccgucggcgucguccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16472 - RNA, 1617 nt, Artificial Sequence
  derived and/or modified sequence opt2 from VP1__Norovirus_and/or_Norovirus-like__KU678203
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16473 - RNA, 1617 nt, Artificial Sequence
  derived and/or modified sequence opt2 from VP1__Norovirus_and/or_Norovirus-like__KP176410
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacaccgaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16474 - RNA, 1617 nt, Artificial Sequence
  derived and/or modified sequence opt2 from VP1__Norovirus_and/or_Norovirus-like__KX371609
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccacccgcggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16475 - RNA, 1617 nt, Artificial Sequence
  derived and/or modified sequence opt2 from VP1__Norovirus_and/or_Norovirus-like__KX354130
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacaucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgaguucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16476 - RNA, 1617 nt, Artificial Sequence
  derived and/or modified sequence opt2 from VP1__Norovirus_and/or_Norovirus-like__KX354120
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggucaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16477 - RNA, 1617 nt, Artificial Sequence
  derived and/or modified sequence opt2 from VP1__Norovirus_and/or_Norovirus-like__KX354113
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16478 - RNA, 1617 nt, Artificial Sequence
  derived and/or modified sequence opt2 from VP1__Norovirus_and/or_Norovirus-like__KX354105
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16479 - RNA, 1617 nt, Artificial Sequence
  derived and/or modified sequence opt2 from VP1__Norovirus_and/or_Norovirus-like__KX354077
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccacccgcggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcuccguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16480 - RNA, 1617 nt, Artificial Sequence
  derived and/or modified sequence opt2 from VP1__Norovirus_and/or_Norovirus-like__KR131785
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16481 - RNA, 1617 nt, Artificial Sequence
  derived and/or modified sequence opt2 from VP1__Norovirus_and/or_Norovirus-like__AB972530
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16482 - RNA, 1617 nt, Artificial Sequence
  derived and/or modified sequence opt2 from VP1__Norovirus_and/or_Norovirus-like__AB972526
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16483 - RNA, 1617 nt, Artificial Sequence
  derived and/or modified sequence opt2 from VP1__Norovirus_and/or_Norovirus-like__AB972522
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucgcccccaagcucggccgcauccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16484 - RNA, 1617 nt, Artificial Sequence
  derived and/or modified sequence opt2 from VP1__Norovirus_and/or_Norovirus-like__AB972514
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaucaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16485 - RNA, 1617 nt, Artificial Sequence
  derived and/or modified sequence opt2 from VP1__Norovirus_and/or_Norovirus-like__AB972505
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccgcccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16486 - RNA, 1617 nt, Artificial Sequence
  derived and/or modified sequence opt2 from VP1__Norovirus_and/or_Norovirus-like__AB972473
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16487 - RNA, 1617 nt, Artificial Sequence
  derived and/or modified sequence opt2 from VP1__Norovirus_and/or_Norovirus-like__KT780381
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggacauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16488 - RNA, 1617 nt, Artificial Sequence
  derived and/or modified sequence opt2 from VP1__Norovirus_and/or_Norovirus-like__KT780372
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagguccuccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16489 - RNA, 1617 nt, Artificial Sequence
  derived and/or modified sequence opt2 from VP1__Norovirus_and/or_Norovirus-like__KT202797
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcuccacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16490 - RNA, 1617 nt, Artificial Sequence
  derived and/or modified sequence opt2 from VP1__Norovirus_and/or_Norovirus-like__KR904226
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcuccgcccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16491 - RNA, 1617 nt, Artificial Sequence
  derived and/or modified sequence opt2 from VP1__Norovirus_and/or_Norovirus-like__KR904208
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccacuucuacacccucgcccccgucggcaacggcaccggccgccgccgcuga

SEQ ID NO: 16492 - RNA, 1617 nt, Artificial Sequence
  derived and/or modified sequence opt2 from VP1__Norovirus_and/or_Norovirus-like__AB933709
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccacgacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16493 - RNA, 1617 nt, Artificial Sequence
  derived and/or modified sequence opt2 from VP1__Norovirus_and/or_Norovirus-like__EU921352
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccgacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16494 - RNA, 1617 nt, Artificial Sequence
  derived and/or modified sequence opt2 from VP1__Norovirus_and/or_Norovirus-like__LC005735
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16495 - RNA, 1617 nt, Artificial Sequence
  derived and/or modified sequence opt2 from VP1__Norovirus_and/or_Norovirus-like__KP241909
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacaccgaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16496 - RNA, 1617 nt, Artificial Sequence
  derived and/or modified sequence opt2 from VP1__Norovirus_and/or_Norovirus-like__KJ533132
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcuga

SEQ ID NO: 16497 - RNA, 1617 nt, Artificial Sequence
  derived and/or modified sequence opt2 from VP1__Norovirus_and/or_Norovirus-like__KP176407
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgagcucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaaccgcgaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16498 - RNA, 1617 nt, Artificial Sequence
  derived and/or modified sequence opt2 from VP1__Norovirus_and/or_Norovirus-like__KP176406
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcauccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16499 - RNA, 1617 nt, Artificial Sequence
  derived and/or modified sequence opt2 from VP1__Norovirus_and/or_Norovirus-like__KP123606
augaagauggccuccuccgacgccaaccccuccgacggcuccgccgccaaccucguccccgaggucaacaacgaggucauggcccucgagcccgucgucggcgccaccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcauccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16500 - RNA, 1617 nt, Artificial Sequence
  derived and/or modified sequence opt2 from VP1__Norovirus_and/or_Norovirus-like__KP096335
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucaccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16501 - RNA, 1617 nt, Artificial Sequence
  derived and/or modified sequence opt2 from VP1__Norovirus_and/or_Norovirus-like__KM268095
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16502 - RNA, 1617 nt, Artificial Sequence
  derived and/or modified sequence opt2 from VP1__Norovirus_and/or_Norovirus-like__KM268094
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16503 - RNA, 1617 nt, Artificial Sequence
  derived and/or modified sequence opt2 from VP1__Norovirus_and/or_Norovirus-like__KM268093
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16504 - RNA, 1617 nt, Artificial Sequence
  derived and/or modified sequence opt2 from VP1__Norovirus_and/or_Norovirus-like__KM198591
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16505 - RNA, 1617 nt, Artificial Sequence
  derived and/or modified sequence opt2 from VP1__Norovirus_and/or_Norovirus-like__KM198589
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagauccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccaccgcuccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16506 - RNA, 1617 nt, Artificial Sequence
  derived and/or modified sequence opt2 from VP1__Norovirus_and/or_Norovirus-like__KM198576
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16507 - RNA, 1617 nt, Artificial Sequence
  derived and/or modified sequence opt2 from VP1__Norovirus_and/or_Norovirus-like__KM198564
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16508 - RNA, 1617 nt, Artificial Sequence
  derived and/or modified sequence opt2 from VP1__Norovirus_and/or_Norovirus-like__KJ716355
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16509 - RNA, 1617 nt, Artificial Sequence
  derived and/or modified sequence opt2 from VP1__Norovirus_and/or_Norovirus-like__KJ685408
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccagaacgagccccagcaguggguccuccccuccuacuccggccgcgacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16510 - RNA, 1617 nt, Artificial Sequence
  derived and/or modified sequence opt2 from VP1__Norovirus_and/or_Norovirus-like__KJ144999
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccaacuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16511 - RNA, 1617 nt, Artificial Sequence
  derived and/or modified sequence opt2 from VP1__Norovirus_and/or_Norovirus-like__KF060016
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16512 - RNA, 1617 nt, Artificial Sequence
  derived and/or modified sequence opt2 from VP1__Norovirus_and/or_Norovirus-like__KC517367
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgccuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccgcccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16513 - RNA, 1617 nt, Artificial Sequence
  derived and/or modified sequence opt2 from VP1__Norovirus_and/or_Norovirus-like__KC517366
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaacuccgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16514 - RNA, 1617 nt, Artificial Sequence
  derived and/or modified sequence opt2 from VP1__Norovirus_and/or_Norovirus-like__KC517359
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccgccucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccuacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaucaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucaucaucccccccaacggcuacuuccgcuucgacuccugggucaaccaguucuacacccucgcccccaugggcaacggcaccggccgccgccgcuga

SEQ ID NO: 16515 - RNA, 1617 nt, Artificial Sequence
  derived and/or modified sequence opt2 from VP1__Norovirus_and/or_Norovirus-like__KC409303
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16516 - RNA, 1617 nt, Artificial Sequence
  derived and/or modified sequence opt2 from VP1__Norovirus_and/or_Norovirus-like__JX459608
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagacccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16517 - RNA, 1617 nt, Artificial Sequence
  derived and/or modified sequence opt2 from VP1__Norovirus_and/or_Norovirus-like__JQ320073
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16518 - RNA, 1617 nt, Artificial Sequence
  derived and/or modified sequence opt2 from VP1__Norovirus_and/or_Norovirus-like__HM802552
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16519 - RNA, 1617 nt, Artificial Sequence
  derived and/or modified sequence opt2 from VP1__Norovirus_and/or_Norovirus-like__AB541320
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgccucccgcaccaagcccuucuccguccccuccgucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccaccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16520 - RNA, 1617 nt, Artificial Sequence
  derived and/or modified sequence opt2 from VP1__Norovirus_and/or_Norovirus-like__AB541227
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16521 - RNA, 1617 nt, Artificial Sequence
  derived and/or modified sequence opt2 from VP1__Norovirus_and/or_Norovirus-like__AB504318
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcggcguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16522 - RNA, 1617 nt, Artificial Sequence
  derived and/or modified sequence opt2 from VP1__Norovirus_and/or_Norovirus-like__AB504311
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcaccuacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16523 - RNA, 1617 nt, Artificial Sequence
  derived and/or modified sequence opt2 from VP1__Norovirus_and/or_Norovirus-like__FJ537135
augaagauggccuccuccgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucucccccgaccucaaccccuaccucucccaccucucccgcauguacaacggcuacgccggcggcuucgagguccaggucauccucgccggcaacgccuucaccgccggcaagaucaucuucgccgccaucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaucucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggcaccuccggccacaacguccaccucgcccccgccgucgcccccaccuuccccggcgagcagcuccucuucuuccgcuccaccaugcccggcugcuccggcuaccccaacaugaaccucgacugccuccucccccaggagugggucucccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcuccggccgcaagcgcgucuga

SEQ ID NO: 16524 - RNA, 1617 nt, Artificial Sequence
  derived and/or modified sequence opt2 from VP1__Norovirus_and/or_Norovirus-like__GQ413969
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacugguccaacuacgaccccaccgaggagauccccgccccccucggcacccccgacuucgucggcaagauccagggcaugcucacccagaccaccggccgcgacggcuccacccgcggccacaaggccaccguccucaccggcuccgccgacuucgcccccaagcucggccgcguccaguucgccaccgacaccgacaacgacuucgaguccggcgagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16525 - RNA, 1617 nt, Artificial Sequence
  derived and/or modified sequence opt2 from VP1__Norovirus_and/or_Norovirus-like__EU839592
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgccuacaccggcuccgcccccuucacccccaagcucggcuccguccaguucuccaccgacaccgagaacgacuucgagacccaccagaacaccaaguucgcccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16526 - RNA, 1617 nt, Artificial Sequence
  derived and/or modified sequence opt2 from VP1__Norovirus_and/or_Norovirus-like__EU839587
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcgccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16527 - RNA, 1617 nt, Artificial Sequence
  derived and/or modified sequence opt2 from VP1__Norovirus_and/or_Norovirus-like__EU839583
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16528 - RNA, 1617 nt, Artificial Sequence
  derived and/or modified sequence opt2 from VP1__Norovirus_and/or_Norovirus-like__AB303931
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16529 - RNA, 1617 nt, Artificial Sequence
  derived and/or modified sequence opt2 from VP1__Norovirus_and/or_Norovirus-like__KY341923
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccuuccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16530 - RNA, 1617 nt, Artificial Sequence
  derived and/or modified sequence opt2 from VP1__Norovirus_and/or_Norovirus-like__KX514317
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaccaucgacggcgagcuccucggcaccacccagcucuccuccgucaacaucugcaccuuccgcggcgacgucacccacccccgcgacuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 16531 - RNA, 1617 nt, Artificial Sequence
  derived and/or modified sequence opt2 from VP1__Norovirus_and/or_Norovirus-like__KU678204
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16532 - RNA, 1617 nt, Artificial Sequence
  derived and/or modified sequence opt2 from VP1__Norovirus_and/or_Norovirus-like__KX158283
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgccuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgaguucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16533 - RNA, 1617 nt, Artificial Sequence
  derived and/or modified sequence opt2 from VP1__Norovirus_and/or_Norovirus-like__KX354088
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcucuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacacccgcuucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcuga

SEQ ID NO: 16534 - RNA, 1617 nt, Artificial Sequence
  derived and/or modified sequence opt2 from VP1__Norovirus_and/or_Norovirus-like__KX354032
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16535 - RNA, 1617 nt, Artificial Sequence
  derived and/or modified sequence opt2 from VP1__Norovirus_and/or_Norovirus-like__KX354015
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggacuggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16536 - RNA, 1617 nt, Artificial Sequence
  derived and/or modified sequence opt2 from VP1__Norovirus_and/or_Norovirus-like__KX353999
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccaccuccaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16537 - RNA, 1617 nt, Artificial Sequence
  derived and/or modified sequence opt2 from VP1__Norovirus_and/or_Norovirus-like__KX353987
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16538 - RNA, 1617 nt, Artificial Sequence
  derived and/or modified sequence opt2 from VP1__Norovirus_and/or_Norovirus-like__KX353970
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcuga

SEQ ID NO: 16539 - RNA, 1617 nt, Artificial Sequence
  derived and/or modified sequence opt2 from VP1__Norovirus_and/or_Norovirus-like__KU985156
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16540 - RNA, 1617 nt, Artificial Sequence
  derived and/or modified sequence opt2 from VP1__Norovirus_and/or_Norovirus-like__KU985155
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggucaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16541 - RNA, 1617 nt, Artificial Sequence
  derived and/or modified sequence opt2 from VP1__Norovirus_and/or_Norovirus-like__KM514075
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16542 - RNA, 1617 nt, Artificial Sequence
  derived and/or modified sequence opt2 from VP1__Norovirus_and/or_Norovirus-like__AB972484
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcgacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16543 - RNA, 1617 nt, Artificial Sequence
  derived and/or modified sequence opt2 from VP1__Norovirus_and/or_Norovirus-like__KT780391
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16544 - RNA, 1617 nt, Artificial Sequence
  derived and/or modified sequence opt2 from VP1__Norovirus_and/or_Norovirus-like__KT780390
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgaccucgaggccaaccagaacaccaaguucacccccgucggcgucauccaggacggcggcgccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16545 - RNA, 1617 nt, Artificial Sequence
  derived and/or modified sequence opt2 from VP1__Norovirus_and/or_Norovirus-like__KT780376
augaagauggccuccuccgacgccaaccccuccgacggcuccgccgccaaccucguccccgaggucaacaacgagguccucgcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16546 - RNA, 1617 nt, Artificial Sequence
  derived and/or modified sequence opt2 from VP1__Norovirus_and/or_Norovirus-like__KT780375
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16547 - RNA, 1617 nt, Artificial Sequence
  derived and/or modified sequence opt2 from VP1__Norovirus_and/or_Norovirus-like__LC016607
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccaacacccacaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucaccaccgacaccgacaacgacuucgagaccggccagaacacccgcuucacccccgucggcgucauccaggacggcaacggcgcccaccgcaacgagccccagcaguggguccuccccgacuacuccggcggcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16548 - RNA, 1617 nt, Artificial Sequence
  derived and/or modified sequence opt2 from VP1__Norovirus_and/or_Norovirus-like__KP241915
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16549 - RNA, 1617 nt, Artificial Sequence
  derived and/or modified sequence opt2 from VP1__Norovirus_and/or_Norovirus-like__KM514065
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccggcuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16550 - RNA, 1617 nt, Artificial Sequence
  derived and/or modified sequence opt2 from VP1__Norovirus_and/or_Norovirus-like__KM268097
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16551 - RNA, 1617 nt, Artificial Sequence
  derived and/or modified sequence opt2 from VP1__Norovirus_and/or_Norovirus-like__KM268084
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucgcccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccaccaagaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16552 - RNA, 1617 nt, Artificial Sequence
  derived and/or modified sequence opt2 from VP1__Norovirus_and/or_Norovirus-like__KJ649704
augaagauggccuccuccgacgccaaccccuccgacggcuccgccgccaaccucguccccgaggucaacaacgagguccucgcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcauccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16553 - RNA, 1617 nt, Artificial Sequence
  derived and/or modified sequence opt2 from VP1__Norovirus_and/or_Norovirus-like__KC577174
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcuccuccaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcgccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16554 - RNA, 1617 nt, Artificial Sequence
  derived and/or modified sequence opt2 from VP1__Norovirus_and/or_Norovirus-like__KF177451
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgacaacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccucaucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16555 - RNA, 1617 nt, Artificial Sequence
  derived and/or modified sequence opt2 from VP1__Norovirus_and/or_Norovirus-like__KF177429
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacuccggccagcacgaccucgucaucccccccaacggcuacuuccgcuucgacuccugggucaaccaguucuacacccucgcccccaugggcaacggcaccggccgccgccgcuga

SEQ ID NO: 16556 - RNA, 1617 nt, Artificial Sequence
  derived and/or modified sequence opt2 from VP1__Norovirus_and/or_Norovirus-like__KF060005
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucacccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16557 - RNA, 1617 nt, Artificial Sequence
  derived and/or modified sequence opt2 from VP1__Norovirus_and/or_Norovirus-like__JX439821
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccuccucccgcaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgacaccgacaccgacaacgacuucgagaccaaccagaacaccaaguucacccccgucggcgucauccaggacggcuccaccaccuaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16558 - RNA, 1617 nt, Artificial Sequence
  derived and/or modified sequence opt2 from VP1__Norovirus_and/or_Norovirus-like__KC517361
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccguccacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16559 - RNA, 1617 nt, Artificial Sequence
  derived and/or modified sequence opt2 from VP1__Norovirus_and/or_Norovirus-like__KC175378
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16560 - RNA, 1617 nt, Artificial Sequence
  derived and/or modified sequence opt2 from VP1__Norovirus_and/or_Norovirus-like__JX459648
augaagauggccuccaacgacgccaaccccuccgagggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcaccauccgcugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuucuccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagucccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccucaucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16561 - RNA, 1617 nt, Artificial Sequence
  derived and/or modified sequence opt2 from VP1__Norovirus_and/or_Norovirus-like__JX459635
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucauccucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccgccgcaacgagccccagcaguggguccuccccuccuacuccggccgcaacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16562 - RNA, 1617 nt, Artificial Sequence
  derived and/or modified sequence opt2 from VP1__Norovirus_and/or_Norovirus-like__JX459624
augaagauggccuccaacgacgcccaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcccccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16563 - RNA, 1617 nt, Artificial Sequence
  derived and/or modified sequence opt2 from VP1__Norovirus_and/or_Norovirus-like__JX459614
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguacgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16564 - RNA, 1617 nt, Artificial Sequence
  derived and/or modified sequence opt2 from VP1__Norovirus_and/or_Norovirus-like__HM635103
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgaccucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16565 - RNA, 1617 nt, Artificial Sequence
  derived and/or modified sequence opt2 from VP1__Norovirus_and/or_Norovirus-like__JQ613522
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16566 - RNA, 1617 nt, Artificial Sequence
  derived and/or modified sequence opt2 from VP1__Norovirus_and/or_Norovirus-like__AB629942
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacacccagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagucccgcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16567 - RNA, 1617 nt, Artificial Sequence
  derived and/or modified sequence opt2 from VP1__Norovirus_and/or_Norovirus-like__GQ856457
augaagauggccuccaacgacgccaaccccuccgacggccccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcuccuccaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacacccagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagucccgcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16568 - RNA, 1617 nt, Artificial Sequence
  derived and/or modified sequence opt2 from VP1__Norovirus_and/or_Norovirus-like__EU876883
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguccccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccaacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16569 - RNA, 1617 nt, Artificial Sequence
  derived and/or modified sequence opt2 from VP1__Norovirus_and/or_Norovirus-like__AB447455
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucuccuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16570 - RNA, 1617 nt, Artificial Sequence
  derived and/or modified sequence opt2 from VP1__Norovirus_and/or_Norovirus-like__EU078409
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacacccgcuucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16571 - RNA, 1617 nt, Artificial Sequence
  derived and/or modified sequence opt2 from VP1__Norovirus_and/or_Norovirus-like__AB303928
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcacccuccgcggcgacgucacccacaucgccggcacccacaacuacaccaugaaccucgccucccagaacuggaacaacuacgaccccaccgaggagauccccgccccccucggcacccccgacuucgucggccgcauccagggcguccucacccagaccacccgcggcgacggcuccacccgcggccacaaggccaccgucuccaccggcgacguccacuucacccccaagcucggcuccguccaguucaacaccgacaccaacaacgacuucgagaucggccagaacacccgcuucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16572 - RNA, 1617 nt, Artificial Sequence
  derived and/or modified sequence opt2 from VP1__Norovirus_and/or_Norovirus-like__AY502023
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16573 - RNA, 1617 nt, Artificial Sequence
  derived and/or modified sequence opt2 from VP1__Norovirus_and/or_Norovirus-like__KU678202
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccaacaacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16574 - RNA, 1617 nt, Artificial Sequence
  derived and/or modified sequence opt2 from VP1__Norovirus_and/or_Norovirus-like__KX371607
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16575 - RNA, 1617 nt, Artificial Sequence
  derived and/or modified sequence opt2 from VP1__Norovirus_and/or_Norovirus-like__KX354112
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaucggccagcacgaccucgucaucccccccaacggcuacuuccgcuucgacuccugggucaaccaguucuacacccucgcccccaugggcaacggcaccggccgccgccgcuga

SEQ ID NO: 16576 - RNA, 1617 nt, Artificial Sequence
  derived and/or modified sequence opt2 from VP1__Norovirus_and/or_Norovirus-like__KX353993
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcgccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16577 - RNA, 1617 nt, Artificial Sequence
  derived and/or modified sequence opt2 from VP1__Norovirus_and/or_Norovirus-like__KR131762
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16578 - RNA, 1617 nt, Artificial Sequence
  derived and/or modified sequence opt2 from VP1__Norovirus_and/or_Norovirus-like__AB972519
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16579 - RNA, 1617 nt, Artificial Sequence
  derived and/or modified sequence opt2 from VP1__Norovirus_and/or_Norovirus-like__AB972498
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggagcucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16580 - RNA, 1617 nt, Artificial Sequence
  derived and/or modified sequence opt2 from VP1__Norovirus_and/or_Norovirus-like__AB972488
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucguccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16581 - RNA, 1617 nt, Artificial Sequence
  derived and/or modified sequence opt2 from VP1__Norovirus_and/or_Norovirus-like__AB972483
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16582 - RNA, 1617 nt, Artificial Sequence
  derived and/or modified sequence opt2 from VP1__Norovirus_and/or_Norovirus-like__KP864106
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16583 - RNA, 1617 nt, Artificial Sequence
  derived and/or modified sequence opt2 from VP1__Norovirus_and/or_Norovirus-like__KR904216
augaagauggccuccuccgacgccaaccccuccgacggcuccaccgccaaccucgcccccgaggucaacaacgaggucauggcccucgagcccgucgucggcgccgccaucgccgcccccgucgccggccagaagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccgcccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcgcgaccucgucaucccccccaacggcuacuuccgcuucgacuccugggucaaccaguucuacucccucgcccccaugggcaacggcaccggccgccgccgcuga

SEQ ID NO: 16584 - RNA, 1617 nt, Artificial Sequence
  derived and/or modified sequence opt2 from VP1__Norovirus_and/or_Norovirus-like__AB933771
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgaggccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16585 - RNA, 1617 nt, Artificial Sequence
  derived and/or modified sequence opt2 from VP1__Norovirus_and/or_Norovirus-like__LC005732
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16586 - RNA, 1617 nt, Artificial Sequence
  derived and/or modified sequence opt2 from VP1__Norovirus_and/or_Norovirus-like__KP293591
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccgacggcuccacccgcggccacaaggccaccgucuacaccggcuccgccaacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16587 - RNA, 1617 nt, Artificial Sequence
  derived and/or modified sequence opt2 from VP1__Norovirus_and/or_Norovirus-like__KP176396
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccaucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16588 - RNA, 1617 nt, Artificial Sequence
  derived and/or modified sequence opt2 from VP1__Norovirus_and/or_Norovirus-like__KP176394
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccgccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16589 - RNA, 1617 nt, Artificial Sequence
  derived and/or modified sequence opt2 from VP1__Norovirus_and/or_Norovirus-like__KP096348
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgacgccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16590 - RNA, 1617 nt, Artificial Sequence
  derived and/or modified sequence opt2 from VP1__Norovirus_and/or_Norovirus-like__KP096344
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccuccuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16591 - RNA, 1617 nt, Artificial Sequence
  derived and/or modified sequence opt2 from VP1__Norovirus_and/or_Norovirus-like__KM982946
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgagaccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16592 - RNA, 1617 nt, Artificial Sequence
  derived and/or modified sequence opt2 from VP1__Norovirus_and/or_Norovirus-like__KM514070
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacgucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16593 - RNA, 1617 nt, Artificial Sequence
  derived and/or modified sequence opt2 from VP1__Norovirus_and/or_Norovirus-like__KM514061
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16594 - RNA, 1617 nt, Artificial Sequence
  derived and/or modified sequence opt2 from VP1__Norovirus_and/or_Norovirus-like__KM514060
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16595 - RNA, 1617 nt, Artificial Sequence
  derived and/or modified sequence opt2 from VP1__Norovirus_and/or_Norovirus-like__KM268079
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16596 - RNA, 1617 nt, Artificial Sequence
  derived and/or modified sequence opt2 from VP1__Norovirus_and/or_Norovirus-like__KJ710247
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccaucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccaucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16597 - RNA, 1617 nt, Artificial Sequence
  derived and/or modified sequence opt2 from VP1__Norovirus_and/or_Norovirus-like__KJ685405
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16598 - RNA, 1617 nt, Artificial Sequence
  derived and/or modified sequence opt2 from VP1__Norovirus_and/or_Norovirus-like__KF429766
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaucaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16599 - RNA, 1617 nt, Artificial Sequence
  derived and/or modified sequence opt2 from VP1__Norovirus_and/or_Norovirus-like__KF060009
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16600 - RNA, 1617 nt, Artificial Sequence
  derived and/or modified sequence opt2 from VP1__Norovirus_and/or_Norovirus-like__KF059996
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16601 - RNA, 1617 nt, Artificial Sequence
  derived and/or modified sequence opt2 from VP1__Norovirus_and/or_Norovirus-like__HF952130
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16602 - RNA, 1617 nt, Artificial Sequence
  derived and/or modified sequence opt2 from VP1__Norovirus_and/or_Norovirus-like__KC409302
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaucaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16603 - RNA, 1617 nt, Artificial Sequence
  derived and/or modified sequence opt2 from VP1__Norovirus_and/or_Norovirus-like__JX459908
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacgacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16604 - RNA, 1617 nt, Artificial Sequence
  derived and/or modified sequence opt2 from VP1__Norovirus_and/or_Norovirus-like__JX445166
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16605 - RNA, 1617 nt, Artificial Sequence
  derived and/or modified sequence opt2 from VP1__Norovirus_and/or_Norovirus-like__HQ693090
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucgccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucgcccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16606 - RNA, 1617 nt, Artificial Sequence
  derived and/or modified sequence opt2 from VP1__Norovirus_and/or_Norovirus-like__JN400611
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgaccucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16607 - RNA, 1617 nt, Artificial Sequence
  derived and/or modified sequence opt2 from VP1__Norovirus_and/or_Norovirus-like__JN400609
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucggccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16608 - RNA, 1617 nt, Artificial Sequence
  derived and/or modified sequence opt2 from VP1__Norovirus_and/or_Norovirus-like__JQ613517
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgaccccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16609 - RNA, 1617 nt, Artificial Sequence
  derived and/or modified sequence opt2 from VP1__Norovirus_and/or_Norovirus-like__JQ478409
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggcggccgccgcuga

SEQ ID NO: 16610 - RNA, 1617 nt, Artificial Sequence
  derived and/or modified sequence opt2 from VP1__Norovirus_and/or_Norovirus-like__GQ856460
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccgaccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugcccccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16611 - RNA, 1617 nt, Artificial Sequence
  derived and/or modified sequence opt2 from VP1__Norovirus_and/or_Norovirus-like__GQ856449
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacucccgcuucgaccccugggucaaccaguucuacacccucgcccccaugggcaacggcaccggccgccgccgcuga

SEQ ID NO: 16612 - RNA, 1617 nt, Artificial Sequence
  derived and/or modified sequence opt2 from VP1__Norovirus_and/or_Norovirus-like__EU921344
augaagauggccuccuccgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcaugcccacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16613 - RNA, 1617 nt, Artificial Sequence
  derived and/or modified sequence opt2 from VP1__Norovirus_and/or_Norovirus-like__AB541290
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagaaccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16614 - RNA, 1617 nt, Artificial Sequence
  derived and/or modified sequence opt2 from VP1__Norovirus_and/or_Norovirus-like__GQ845322
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16615 - RNA, 1617 nt, Artificial Sequence
  derived and/or modified sequence opt2 from VP1__Norovirus_and/or_Norovirus-like__AB220921
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16616 - RNA, 1617 nt, Artificial Sequence
  derived and/or modified sequence opt2 from VP1__Norovirus_and/or_Norovirus-like__KX514221
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16617 - RNA, 1617 nt, Artificial Sequence
  derived and/or modified sequence opt2 from VP1__Norovirus_and/or_Norovirus-like__KY486271
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16618 - RNA, 1617 nt, Artificial Sequence
  derived and/or modified sequence opt2 from VP1__Norovirus_and/or_Norovirus-like__KP784692
augaagauggccuccuccgacgccaaccccuccgacggcuccaccgccaaccucguccccgaggucaacaacgaggucauggcccucgagcccgucgucggcgccgcccucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaguccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaacugguccaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucacccccaagcucggccgcguccaguucgccaccgacaccgaccacgacuucgacaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggagugggucgcccacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16619 - RNA, 1617 nt, Artificial Sequence
  derived and/or modified sequence opt2 from VP1__Norovirus_and/or_Norovirus-like__KX371604
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccaucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16620 - RNA, 1617 nt, Artificial Sequence
  derived and/or modified sequence opt2 from VP1__Norovirus_and/or_Norovirus-like__KX354079
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagguccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucgccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcuccggcaccggccgccgccgcuga

SEQ ID NO: 16621 - RNA, 1617 nt, Artificial Sequence
  derived and/or modified sequence opt2 from VP1__Norovirus_and/or_Norovirus-like__KX354028
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16622 - RNA, 1617 nt, Artificial Sequence
  derived and/or modified sequence opt2 from VP1__Norovirus_and/or_Norovirus-like__KX353983
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16623 - RNA, 1617 nt, Artificial Sequence
  derived and/or modified sequence opt2 from VP1__Norovirus_and/or_Norovirus-like__AB972511
augaagauggccuccaacgacgccaaccccuccgacggccccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaucaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16624 - RNA, 1617 nt, Artificial Sequence
  derived and/or modified sequence opt2 from VP1__Norovirus_and/or_Norovirus-like__AB972478
augaagauggccuccuccgacgccaaccccaccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16625 - RNA, 1617 nt, Artificial Sequence
  derived and/or modified sequence opt2 from VP1__Norovirus_and/or_Norovirus-like__KT780382
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16626 - RNA, 1617 nt, Artificial Sequence
  derived and/or modified sequence opt2 from VP1__Norovirus_and/or_Norovirus-like__KT033905
augaagauggccuccaacgacgccaaccccuccgacggcuccgccgccaaccucguccccaaggucaacaacgaggucauggcccucgagcccgucgucggcgccgccaucgccgcccccgucgccggccagcagaacgucaucgaccccuggauccgcaacaacuucguccaggcccccggcggcaaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16627 - RNA, 1617 nt, Artificial Sequence
  derived and/or modified sequence opt2 from VP1__Norovirus_and/or_Norovirus-like__KR904207
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuccucccccaagcucggccgcguccaguucgccaccgacaccgacaacgacuucgucgccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucacccaggcccacaccggccagcacgaccucgucaucccccccaacggcuacuuccgcuucgacuccugggucaaccaguucuacacccucgcccccaugggcaacggcaccggccgccgccgcuga

SEQ ID NO: 16628 - RNA, 1617 nt, Artificial Sequence
  derived and/or modified sequence opt2 from VP1__Norovirus_and/or_Norovirus-like__KJ678151
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16629 - RNA, 1617 nt, Artificial Sequence
  derived and/or modified sequence opt2 from VP1__Norovirus_and/or_Norovirus-like__KJ678143
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16630 - RNA, 1617 nt, Artificial Sequence
  derived and/or modified sequence opt2 from VP1__Norovirus_and/or_Norovirus-like__KP698927
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucggcaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16631 - RNA, 1617 nt, Artificial Sequence
  derived and/or modified sequence opt2 from VP1__Norovirus_and/or_Norovirus-like__LC005730
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16632 - RNA, 1617 nt, Artificial Sequence
  derived and/or modified sequence opt2 from VP1__Norovirus_and/or_Norovirus-like__LC005714
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16633 - RNA, 1617 nt, Artificial Sequence
  derived and/or modified sequence opt2 from VP1__Norovirus_and/or_Norovirus-like__KP241906
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16634 - RNA, 1617 nt, Artificial Sequence
  derived and/or modified sequence opt2 from VP1__Norovirus_and/or_Norovirus-like__KM982938
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggccuccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16635 - RNA, 1617 nt, Artificial Sequence
  derived and/or modified sequence opt2 from VP1__Norovirus_and/or_Norovirus-like__KM514058
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggccuccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16636 - RNA, 1617 nt, Artificial Sequence
  derived and/or modified sequence opt2 from VP1__Norovirus_and/or_Norovirus-like__KM198580
augaagauggccuccaacgacgccaaccccaccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16637 - RNA, 1617 nt, Artificial Sequence
  derived and/or modified sequence opt2 from VP1__Norovirus_and/or_Norovirus-like__KM198537
augaagauggcccccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggggcgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaacggccagcacgaccucgucaucccccccaacggcuacuuccgcuucgacuccugggucaaccaguucuacacccucgcccccaugggcaacggcaccggccgccgccgcuga

SEQ ID NO: 16638 - RNA, 1617 nt, Artificial Sequence
  derived and/or modified sequence opt2 from VP1__Norovirus_and/or_Norovirus-like__KF177450
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccucaucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16639 - RNA, 1617 nt, Artificial Sequence
  derived and/or modified sequence opt2 from VP1__Norovirus_and/or_Norovirus-like__KF008243
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccaccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16640 - RNA, 1617 nt, Artificial Sequence
  derived and/or modified sequence opt2 from VP1__Norovirus_and/or_Norovirus-like__KF429782
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagccccuccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccaucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcacccacaacuacgccaugaaccucgccgcccagaacuggaacuccuacgaccccaccgaggagauccccgccccccucggcacccccgacuucgucggcaagauccagggcguccucacccagaccacccgcgccgacggcuccacccgcgcccacaaggccaccgucuacaccggcuccgccgaguucgcccccaagcucggccgcguccaguucgccaccgacaccgacuccgacuucgacaccaaccagaacaccaaguucacccccgucggcgucauccaggacggcaacaccgcccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucucccccuucuacacccucgcccccaugggcaacggcaccggccgccgccgcuga

SEQ ID NO: 16641 - RNA, 1617 nt, Artificial Sequence
  derived and/or modified sequence opt2 from VP1__Norovirus_and/or_Norovirus-like__KF060101
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgucgccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16642 - RNA, 1617 nt, Artificial Sequence
  derived and/or modified sequence opt2 from VP1__Norovirus_and/or_Norovirus-like__KF060096
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgucuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16643 - RNA, 1617 nt, Artificial Sequence
  derived and/or modified sequence opt2 from VP1__Norovirus_and/or_Norovirus-like__KF060071
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgucucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16644 - RNA, 1617 nt, Artificial Sequence
  derived and/or modified sequence opt2 from VP1__Norovirus_and/or_Norovirus-like__KF060056
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16645 - RNA, 1617 nt, Artificial Sequence
  derived and/or modified sequence opt2 from VP1__Norovirus_and/or_Norovirus-like__JX439836
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccucccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16646 - RNA, 1617 nt, Artificial Sequence
  derived and/or modified sequence opt2 from VP1__Norovirus_and/or_Norovirus-like__HF952129
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16647 - RNA, 1617 nt, Artificial Sequence
  derived and/or modified sequence opt2 from VP1__Norovirus_and/or_Norovirus-like__KC409273
augaagauggccuccaacgacgccaaccccuccgacggcuccgccgccucccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgccgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16648 - RNA, 1617 nt, Artificial Sequence
  derived and/or modified sequence opt2 from VP1__Norovirus_and/or_Norovirus-like__KC409242
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16649 - RNA, 1617 nt, Artificial Sequence
  derived and/or modified sequence opt2 from VP1__Norovirus_and/or_Norovirus-like__JX445167
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagguccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16650 - RNA, 1617 nt, Artificial Sequence
  derived and/or modified sequence opt2 from VP1__Norovirus_and/or_Norovirus-like__JX445156
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccucggcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16651 - RNA, 1617 nt, Artificial Sequence
  derived and/or modified sequence opt2 from VP1__Norovirus_and/or_Norovirus-like__GQ856458
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgcccucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccccacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16652 - RNA, 1617 nt, Artificial Sequence
  derived and/or modified sequence opt2 from VP1__Norovirus_and/or_Norovirus-like__AB541299
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcacucccucuacuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16653 - RNA, 1617 nt, Artificial Sequence
  derived and/or modified sequence opt2 from VP1__Norovirus_and/or_Norovirus-like__AB541195
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcaacguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16654 - RNA, 1617 nt, Artificial Sequence
  derived and/or modified sequence opt2 from VP1__Norovirus_and/or_Norovirus-like__AB504322
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccggcuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16655 - RNA, 1617 nt, Artificial Sequence
  derived and/or modified sequence opt2 from VP1__Norovirus_and/or_Norovirus-like__EU876892
augaagauggccuccaacgacgccaaccccuccgacggcuccgccgccaaccucguccucgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16656 - RNA, 1617 nt, Artificial Sequence
  derived and/or modified sequence opt2 from VP1__Norovirus_and/or_Norovirus-like__EU876891
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgagaagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16657 - RNA, 1617 nt, Artificial Sequence
  derived and/or modified sequence opt2 from VP1__Norovirus_and/or_Norovirus-like__AB294792
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgacguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16658 - RNA, 1617 nt, Artificial Sequence
  derived and/or modified sequence opt2 from VP1__Norovirus_and/or_Norovirus-like__AB303932
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccguccaguucaacaccgacaccaacaacgacuucgagaccggccagaacacccgcuucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16659 - RNA, 1617 nt, Artificial Sequence
  derived and/or modified sequence opt2 from VP1__Norovirus_and/or_Norovirus-like__LC177660
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcucggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16660 - RNA, 1617 nt, Artificial Sequence
  derived and/or modified sequence opt2 from VP1__Norovirus_and/or_Norovirus-like__KX608866
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucgccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16661 - RNA, 1617 nt, Artificial Sequence
  derived and/or modified sequence opt2 from VP1__Norovirus_and/or_Norovirus-like__KX371603
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16662 - RNA, 1617 nt, Artificial Sequence
  derived and/or modified sequence opt2 from VP1__Norovirus_and/or_Norovirus-like__KX354086
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacgacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16663 - RNA, 1617 nt, Artificial Sequence
  derived and/or modified sequence opt2 from VP1__Norovirus_and/or_Norovirus-like__KX354080
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16664 - RNA, 1617 nt, Artificial Sequence
  derived and/or modified sequence opt2 from VP1__Norovirus_and/or_Norovirus-like__KX354054
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16665 - RNA, 1617 nt, Artificial Sequence
  derived and/or modified sequence opt2 from VP1__Norovirus_and/or_Norovirus-like__KX354041
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucucccuccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgucgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16666 - RNA, 1617 nt, Artificial Sequence
  derived and/or modified sequence opt2 from VP1__Norovirus_and/or_Norovirus-like__KX354029
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcuga

SEQ ID NO: 16667 - RNA, 1617 nt, Artificial Sequence
  derived and/or modified sequence opt2 from VP1__Norovirus_and/or_Norovirus-like__KX353977
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16668 - RNA, 1617 nt, Artificial Sequence
  derived and/or modified sequence opt2 from VP1__Norovirus_and/or_Norovirus-like__KX353965
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacacccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16669 - RNA, 1617 nt, Artificial Sequence
  derived and/or modified sequence opt2 from VP1__Norovirus_and/or_Norovirus-like__KU311158
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16670 - RNA, 1617 nt, Artificial Sequence
  derived and/or modified sequence opt2 from VP1__Norovirus_and/or_Norovirus-like__AB974408
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucaccacccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16671 - RNA, 1617 nt, Artificial Sequence
  derived and/or modified sequence opt2 from VP1__Norovirus_and/or_Norovirus-like__KR904221
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16672 - RNA, 1617 nt, Artificial Sequence
  derived and/or modified sequence opt2 from VP1__Norovirus_and/or_Norovirus-like__AB933765
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgagccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16673 - RNA, 1617 nt, Artificial Sequence
  derived and/or modified sequence opt2 from VP1__Norovirus_and/or_Norovirus-like__AB933761
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaucaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16674 - RNA, 1617 nt, Artificial Sequence
  derived and/or modified sequence opt2 from VP1__Norovirus_and/or_Norovirus-like__AB933748
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccggcacccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16675 - RNA, 1617 nt, Artificial Sequence
  derived and/or modified sequence opt2 from VP1__Norovirus_and/or_Norovirus-like__EU921386
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucauccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16676 - RNA, 1617 nt, Artificial Sequence
  derived and/or modified sequence opt2 from VP1__Norovirus_and/or_Norovirus-like__KP244321
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggaugcuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16677 - RNA, 1617 nt, Artificial Sequence
  derived and/or modified sequence opt2 from VP1__Norovirus_and/or_Norovirus-like__KP698923
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgccgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16678 - RNA, 1617 nt, Artificial Sequence
  derived and/or modified sequence opt2 from VP1__Norovirus_and/or_Norovirus-like__KP241905
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcauccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16679 - RNA, 1617 nt, Artificial Sequence
  derived and/or modified sequence opt2 from VP1__Norovirus_and/or_Norovirus-like__KP176393
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccuccauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16680 - RNA, 1617 nt, Artificial Sequence
  derived and/or modified sequence opt2 from VP1__Norovirus_and/or_Norovirus-like__KP096330
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16681 - RNA, 1617 nt, Artificial Sequence
  derived and/or modified sequence opt2 from VP1__Norovirus_and/or_Norovirus-like__KM982953
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcauccccgacuucgucggcaagauccagggcaugcucacccagaccacccgcaccgacggcuccacccgcggccacaaggccaccgucuacaccggcuccgucgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16682 - RNA, 1617 nt, Artificial Sequence
  derived and/or modified sequence opt2 from VP1__Norovirus_and/or_Norovirus-like__KM982936
augaagauggccuccuccgacgccaaccccuccgacggcuccgccgccaaccucguccccgaggucaacaacgagguccucgcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16683 - RNA, 1617 nt, Artificial Sequence
  derived and/or modified sequence opt2 from VP1__Norovirus_and/or_Norovirus-like__KM514073
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagguccuccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16684 - RNA, 1617 nt, Artificial Sequence
  derived and/or modified sequence opt2 from VP1__Norovirus_and/or_Norovirus-like__KM268086
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucgcccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16685 - RNA, 1617 nt, Artificial Sequence
  derived and/or modified sequence opt2 from VP1__Norovirus_and/or_Norovirus-like__KM198552
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccuccaucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgccgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16686 - RNA, 1617 nt, Artificial Sequence
  derived and/or modified sequence opt2 from VP1__Norovirus_and/or_Norovirus-like__KJ716358
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgccgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaucaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16687 - RNA, 1617 nt, Artificial Sequence
  derived and/or modified sequence opt2 from VP1__Norovirus_and/or_Norovirus-like__KJ649702
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16688 - RNA, 1617 nt, Artificial Sequence
  derived and/or modified sequence opt2 from VP1__Norovirus_and/or_Norovirus-like__KF429778
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcggcaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16689 - RNA, 1617 nt, Artificial Sequence
  derived and/or modified sequence opt2 from VP1__Norovirus_and/or_Norovirus-like__KF060113
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcgccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16690 - RNA, 1617 nt, Artificial Sequence
  derived and/or modified sequence opt2 from VP1__Norovirus_and/or_Norovirus-like__KF060106
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16691 - RNA, 1617 nt, Artificial Sequence
  derived and/or modified sequence opt2 from VP1__Norovirus_and/or_Norovirus-like__KF060100
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcaugcucacccagaccacccgcaccgacggcuccacccgcggccacaaggccaccgucuacaccggcuccgucgacuucucccccaagcucggccgcguccaguucaccaccgacaccgacaacgacuucgagaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16692 - RNA, 1617 nt, Artificial Sequence
  derived and/or modified sequence opt2 from VP1__Norovirus_and/or_Norovirus-like__KF060069
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16693 - RNA, 1617 nt, Artificial Sequence
  derived and/or modified sequence opt2 from VP1__Norovirus_and/or_Norovirus-like__KF060055
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcuga

SEQ ID NO: 16694 - RNA, 1617 nt, Artificial Sequence
  derived and/or modified sequence opt2 from VP1__Norovirus_and/or_Norovirus-like__KF060028
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgucgccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16695 - RNA, 1617 nt, Artificial Sequence
  derived and/or modified sequence opt2 from VP1__Norovirus_and/or_Norovirus-like__KF060022
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcgccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16696 - RNA, 1617 nt, Artificial Sequence
  derived and/or modified sequence opt2 from VP1__Norovirus_and/or_Norovirus-like__KC517376
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuccaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16697 - RNA, 1617 nt, Artificial Sequence
  derived and/or modified sequence opt2 from VP1__Norovirus_and/or_Norovirus-like__KC517374
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccacuccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcuccggcaccggccgccgccgcuga

SEQ ID NO: 16698 - RNA, 1617 nt, Artificial Sequence
  derived and/or modified sequence opt2 from VP1__Norovirus_and/or_Norovirus-like__KC409308
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggaugcuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16699 - RNA, 1617 nt, Artificial Sequence
  derived and/or modified sequence opt2 from VP1__Norovirus_and/or_Norovirus-like__KC175393
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucuccaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16700 - RNA, 1617 nt, Artificial Sequence
  derived and/or modified sequence opt2 from VP1__Norovirus_and/or_Norovirus-like__JX459623
augaagauggccuccaacgaccccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16701 - RNA, 1617 nt, Artificial Sequence
  derived and/or modified sequence opt2 from VP1__Norovirus_and/or_Norovirus-like__JQ798158
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucgcccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacgucggcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16702 - RNA, 1617 nt, Artificial Sequence
  derived and/or modified sequence opt2 from VP1__Norovirus_and/or_Norovirus-like__JQ613566
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16703 - RNA, 1617 nt, Artificial Sequence
  derived and/or modified sequence opt2 from VP1__Norovirus_and/or_Norovirus-like__AB541287
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagaaccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16704 - RNA, 1617 nt, Artificial Sequence
  derived and/or modified sequence opt2 from VP1__Norovirus_and/or_Norovirus-like__AB504320
augaagauggccuccaacgacgccaaccccuccgacggcuccgccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16705 - RNA, 1617 nt, Artificial Sequence
  derived and/or modified sequence opt2 from VP1__Norovirus_and/or_Norovirus-like__KU683739
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16706 - RNA, 1617 nt, Artificial Sequence
  derived and/or modified sequence opt2 from VP1__Norovirus_and/or_Norovirus-like__KX354146
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgccuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16707 - RNA, 1617 nt, Artificial Sequence
  derived and/or modified sequence opt2 from VP1__Norovirus_and/or_Norovirus-like__KX354075
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16708 - RNA, 1617 nt, Artificial Sequence
  derived and/or modified sequence opt2 from VP1__Norovirus_and/or_Norovirus-like__KX354072
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaagggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacacccccccccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacacccgcuucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16709 - RNA, 1617 nt, Artificial Sequence
  derived and/or modified sequence opt2 from VP1__Norovirus_and/or_Norovirus-like__KX354060
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16710 - RNA, 1617 nt, Artificial Sequence
  derived and/or modified sequence opt2 from VP1__Norovirus_and/or_Norovirus-like__KX353959
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccgccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16711 - RNA, 1617 nt, Artificial Sequence
  derived and/or modified sequence opt2 from VP1__Norovirus_and/or_Norovirus-like__KX353954
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcuccauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16712 - RNA, 1617 nt, Artificial Sequence
  derived and/or modified sequence opt2 from VP1__Norovirus_and/or_Norovirus-like__AB972529
augaagauggccuccuccgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16713 - RNA, 1617 nt, Artificial Sequence
  derived and/or modified sequence opt2 from VP1__Norovirus_and/or_Norovirus-like__AB972504
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16714 - RNA, 1617 nt, Artificial Sequence
  derived and/or modified sequence opt2 from VP1__Norovirus_and/or_Norovirus-like__AB972503
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16715 - RNA, 1617 nt, Artificial Sequence
  derived and/or modified sequence opt2 from VP1__Norovirus_and/or_Norovirus-like__KP244322
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgcccgcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccaacuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16716 - RNA, 1617 nt, Artificial Sequence
  derived and/or modified sequence opt2 from VP1__Norovirus_and/or_Norovirus-like__LC018706
augaagauggccuccuccgacgccaaccccuccgacggcuccgccgccaaccucguccccgaggucaacaacgaggacauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucucccccaagcucggccgcguccaguucgagaccgacaccgaccacgacuucgaggucaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16717 - RNA, 1617 nt, Artificial Sequence
  derived and/or modified sequence opt2 from VP1__Norovirus_and/or_Norovirus-like__KP096345
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggggcaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16718 - RNA, 1617 nt, Artificial Sequence
  derived and/or modified sequence opt2 from VP1__Norovirus_and/or_Norovirus-like__KM982939
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcuga

SEQ ID NO: 16719 - RNA, 1617 nt, Artificial Sequence
  derived and/or modified sequence opt2 from VP1__Norovirus_and/or_Norovirus-like__KM198588
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcagugggcccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16720 - RNA, 1617 nt, Artificial Sequence
  derived and/or modified sequence opt2 from VP1__Norovirus_and/or_Norovirus-like__KM198544
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccaccucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16721 - RNA, 1617 nt, Artificial Sequence
  derived and/or modified sequence opt2 from VP1__Norovirus_and/or_Norovirus-like__KM198522
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16722 - RNA, 1617 nt, Artificial Sequence
  derived and/or modified sequence opt2 from VP1__Norovirus_and/or_Norovirus-like__KM198508
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgccgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16723 - RNA, 1617 nt, Artificial Sequence
  derived and/or modified sequence opt2 from VP1__Norovirus_and/or_Norovirus-like__KJ716367
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggcaucguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16724 - RNA, 1617 nt, Artificial Sequence
  derived and/or modified sequence opt2 from VP1__Norovirus_and/or_Norovirus-like__KF177440
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccuccauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16725 - RNA, 1617 nt, Artificial Sequence
  derived and/or modified sequence opt2 from VP1__Norovirus_and/or_Norovirus-like__KF060117
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16726 - RNA, 1617 nt, Artificial Sequence
  derived and/or modified sequence opt2 from VP1__Norovirus_and/or_Norovirus-like__KF060104
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccuccuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16727 - RNA, 1617 nt, Artificial Sequence
  derived and/or modified sequence opt2 from VP1__Norovirus_and/or_Norovirus-like__KF060095
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacuccgacuucgucaccaaccagaacaccaaguucacccccgucggcgucauccaggacggcuccaccaccccccgcaacgagccccagcaguggguccuccccuccuacuccggccgcuccacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16728 - RNA, 1617 nt, Artificial Sequence
  derived and/or modified sequence opt2 from VP1__Norovirus_and/or_Norovirus-like__KF060084
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16729 - RNA, 1617 nt, Artificial Sequence
  derived and/or modified sequence opt2 from VP1__Norovirus_and/or_Norovirus-like__KF060082
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcuga

SEQ ID NO: 16730 - RNA, 1617 nt, Artificial Sequence
  derived and/or modified sequence opt2 from VP1__Norovirus_and/or_Norovirus-like__KF060079
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16731 - RNA, 1617 nt, Artificial Sequence
  derived and/or modified sequence opt2 from VP1__Norovirus_and/or_Norovirus-like__KF060058
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccuccaccauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16732 - RNA, 1617 nt, Artificial Sequence
  derived and/or modified sequence opt2 from VP1__Norovirus_and/or_Norovirus-like__KF060039
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16733 - RNA, 1617 nt, Artificial Sequence
  derived and/or modified sequence opt2 from VP1__Norovirus_and/or_Norovirus-like__KF060030
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggaacgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16734 - RNA, 1617 nt, Artificial Sequence
  derived and/or modified sequence opt2 from VP1__Norovirus_and/or_Norovirus-like__JX439829
augaagaugggcuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16735 - RNA, 1617 nt, Artificial Sequence
  derived and/or modified sequence opt2 from VP1__Norovirus_and/or_Norovirus-like__KC409282
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagacccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16736 - RNA, 1617 nt, Artificial Sequence
  derived and/or modified sequence opt2 from VP1__Norovirus_and/or_Norovirus-like__KC409259
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16737 - RNA, 1617 nt, Artificial Sequence
  derived and/or modified sequence opt2 from VP1__Norovirus_and/or_Norovirus-like__JX459659
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16738 - RNA, 1617 nt, Artificial Sequence
  derived and/or modified sequence opt2 from VP1__Norovirus_and/or_Norovirus-like__JX459658
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16739 - RNA, 1617 nt, Artificial Sequence
  derived and/or modified sequence opt2 from VP1__Norovirus_and/or_Norovirus-like__JX459595
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucauccccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaguccuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16740 - RNA, 1617 nt, Artificial Sequence
  derived and/or modified sequence opt2 from VP1__Norovirus_and/or_Norovirus-like__JQ613560
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcgccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16741 - RNA, 1617 nt, Artificial Sequence
  derived and/or modified sequence opt2 from VP1__Norovirus_and/or_Norovirus-like__JQ613545
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacaacuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16742 - RNA, 1617 nt, Artificial Sequence
  derived and/or modified sequence opt2 from VP1__Norovirus_and/or_Norovirus-like__AB541288
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccccugguccgccccccucggccccgaccucaaccccuaccucucccaccucgcccgcauguacaacggcuacgccggcggcuucgagguccaggucguccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagaaccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16743 - RNA, 1617 nt, Artificial Sequence
  derived and/or modified sequence opt2 from VP1__Norovirus_and/or_Norovirus-like__AB541247
augaagauggccuccaacgacgccaaccgcuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcuccgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16744 - RNA, 1617 nt, Artificial Sequence
  derived and/or modified sequence opt2 from VP1__Norovirus_and/or_Norovirus-like__EU839585
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucccccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccgucuacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16745 - RNA, 1617 nt, Artificial Sequence
  derived and/or modified sequence opt2 from VP1__Norovirus_and/or_Norovirus-like__AY588021
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacacccgcuucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccacccccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16746 - RNA, 1617 nt, Artificial Sequence
  derived and/or modified sequence opt2 from VP1__Norovirus_and/or_Norovirus-like__KX514188
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgacaagcucuucaccggccccuccuccgccaacgucguccagccccagaacggccgcugcaccaucgacggcgagcuccucggcaccacccagcucucccccgucaacaucugcaccuuccgcggcgacgucacccacccccgcgacucccagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16747 - RNA, 1617 nt, Artificial Sequence
  derived and/or modified sequence opt2 from VP1__Norovirus_and/or_Norovirus-like__KX354101
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16748 - RNA, 1617 nt, Artificial Sequence
  derived and/or modified sequence opt2 from VP1__Norovirus_and/or_Norovirus-like__KX354023
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgccccccccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16749 - RNA, 1617 nt, Artificial Sequence
  derived and/or modified sequence opt2 from VP1__Norovirus_and/or_Norovirus-like__KX353979
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16750 - RNA, 1617 nt, Artificial Sequence
  derived and/or modified sequence opt2 from VP1__Norovirus_and/or_Norovirus-like__AB972491
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16751 - RNA, 1617 nt, Artificial Sequence
  derived and/or modified sequence opt2 from VP1__Norovirus_and/or_Norovirus-like__AB972469
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcacccuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16752 - RNA, 1617 nt, Artificial Sequence
  derived and/or modified sequence opt2 from VP1__Norovirus_and/or_Norovirus-like__LC101819
augaagauggccuccaacgacgacaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcgacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaacaaguucuacacccucgcccccaugggcaacggcaccggccgccgccgcuga

SEQ ID NO: 16753 - RNA, 1617 nt, Artificial Sequence
  derived and/or modified sequence opt2 from VP1__Norovirus_and/or_Norovirus-like__KT202795
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacauccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16754 - RNA, 1617 nt, Artificial Sequence
  derived and/or modified sequence opt2 from VP1__Norovirus_and/or_Norovirus-like__AB933742
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccuggaucaaccaguucuacacccucgcccccaugggcaacggcaccggccgccgccgcuga

SEQ ID NO: 16755 - RNA, 1617 nt, Artificial Sequence
  derived and/or modified sequence opt2 from VP1__Norovirus_and/or_Norovirus-like__AB933722
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcgccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccccaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16756 - RNA, 1617 nt, Artificial Sequence
  derived and/or modified sequence opt2 from VP1__Norovirus_and/or_Norovirus-like__KJ678138
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16757 - RNA, 1617 nt, Artificial Sequence
  derived and/or modified sequence opt2 from VP1__Norovirus_and/or_Norovirus-like__KP244317
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgcccgccucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguuccacacccucgcccccaugggcaacggcaccggccgccgccgcuga

SEQ ID NO: 16758 - RNA, 1617 nt, Artificial Sequence
  derived and/or modified sequence opt2 from VP1__Norovirus_and/or_Norovirus-like__KP698925
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguaccucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16759 - RNA, 1617 nt, Artificial Sequence
  derived and/or modified sequence opt2 from VP1__Norovirus_and/or_Norovirus-like__LC005727
augaagauggccuccuccgacgccaacccccccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16760 - RNA, 1617 nt, Artificial Sequence
  derived and/or modified sequence opt2 from VP1__Norovirus_and/or_Norovirus-like__LC016603
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcaccuccaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccggcgcccaccgcaacgagccccagcaguggguccuccccgacuacuccggcaagaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16761 - RNA, 1617 nt, Artificial Sequence
  derived and/or modified sequence opt2 from VP1__Norovirus_and/or_Norovirus-like__LC016599
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccuccacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16762 - RNA, 1617 nt, Artificial Sequence
  derived and/or modified sequence opt2 from VP1__Norovirus_and/or_Norovirus-like__KP293587
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucaagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacuccuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugcgcaacggcaccggccgccgccgcuga

SEQ ID NO: 16763 - RNA, 1617 nt, Artificial Sequence
  derived and/or modified sequence opt2 from VP1__Norovirus_and/or_Norovirus-like__KP176402
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaaccucguccaggcccccggcggcgaguucaccgucuccccccgcaacgcccccggcgagauccucugguccgccccccucggccccgagcucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16764 - RNA, 1617 nt, Artificial Sequence
  derived and/or modified sequence opt2 from VP1__Norovirus_and/or_Norovirus-like__KJ196287
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggccacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16765 - RNA, 1617 nt, Artificial Sequence
  derived and/or modified sequence opt2 from VP1__Norovirus_and/or_Norovirus-like__KM198480
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcucuacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16766 - RNA, 1617 nt, Artificial Sequence
  derived and/or modified sequence opt2 from VP1__Norovirus_and/or_Norovirus-like__KJ716357
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggccacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16767 - RNA, 1617 nt, Artificial Sequence
  derived and/or modified sequence opt2 from VP1__Norovirus_and/or_Norovirus-like__KJ716354
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16768 - RNA, 1617 nt, Artificial Sequence
  derived and/or modified sequence opt2 from VP1__Norovirus_and/or_Norovirus-like__KJ685403
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucaccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16769 - RNA, 1617 nt, Artificial Sequence
  derived and/or modified sequence opt2 from VP1__Norovirus_and/or_Norovirus-like__KF060108
augaagauggccuccuccgacgccaaccccuccgacggcuccuccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16770 - RNA, 1617 nt, Artificial Sequence
  derived and/or modified sequence opt2 from VP1__Norovirus_and/or_Norovirus-like__KF060099
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16771 - RNA, 1617 nt, Artificial Sequence
  derived and/or modified sequence opt2 from VP1__Norovirus_and/or_Norovirus-like__KF060004
augaagauggccuccuccgacgccaaccccuccgacggcuccgucgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16772 - RNA, 1617 nt, Artificial Sequence
  derived and/or modified sequence opt2 from VP1__Norovirus_and/or_Norovirus-like__KF060006
augaagauggccuccuccgacgccaaccccuccgacggcuccaccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcguccucacccagaccacccgcaucaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16773 - RNA, 1617 nt, Artificial Sequence
  derived and/or modified sequence opt2 from VP1__Norovirus_and/or_Norovirus-like__KC517371
augaagauggccuccaacgacgccaaccccuccgacggcuccgccgccaaccucguccccgaggucgacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgccccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16774 - RNA, 1617 nt, Artificial Sequence
  derived and/or modified sequence opt2 from VP1__Norovirus_and/or_Norovirus-like__JX459657
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16775 - RNA, 1617 nt, Artificial Sequence
  derived and/or modified sequence opt2 from VP1__Norovirus_and/or_Norovirus-like__JX459656
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16776 - RNA, 1617 nt, Artificial Sequence
  derived and/or modified sequence opt2 from VP1__Norovirus_and/or_Norovirus-like__JX445152
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgaggccggccagaacaccaaguucacccccgacggcgucguccaggacggcaacggcacccaccagaacgagccccagcaguggguccuccccuccuacuccggccgcaccggccacaacguccaccucgcccccgccaucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16777 - RNA, 1617 nt, Artificial Sequence
  derived and/or modified sequence opt2 from VP1__Norovirus_and/or_Norovirus-like__JQ613553
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccguccaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16778 - RNA, 1617 nt, Artificial Sequence
  derived and/or modified sequence opt2 from VP1__Norovirus_and/or_Norovirus-like__JQ613521
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagacccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16779 - RNA, 1617 nt, Artificial Sequence
  derived and/or modified sequence opt2 from VP1__Norovirus_and/or_Norovirus-like__HQ005298
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16780 - RNA, 1617 nt, Artificial Sequence
  derived and/or modified sequence opt2 from VP1__Norovirus_and/or_Norovirus-like__HQ005296
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16781 - RNA, 1617 nt, Artificial Sequence
  derived and/or modified sequence opt2 from VP1__Norovirus_and/or_Norovirus-like__HM802555
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16782 - RNA, 1617 nt, Artificial Sequence
  derived and/or modified sequence opt2 from VP1__Norovirus_and/or_Norovirus-like__GQ246801
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcuga

SEQ ID NO: 16783 - RNA, 1617 nt, Artificial Sequence
  derived and/or modified sequence opt2 from VP1__Norovirus_and/or_Norovirus-like__AB504308
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccacggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16784 - RNA, 1617 nt, Artificial Sequence
  derived and/or modified sequence opt2 from VP1__Norovirus_and/or_Norovirus-like__DQ369797
augaagauggcccccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucuccaucugcaccuuccgcggcgacgucacccacauccccggcacccgcaucuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16785 - RNA, 1617 nt, Artificial Sequence
  derived and/or modified sequence opt2 from VP1__Norovirus_and/or_Norovirus-like__LC177661
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccuccaccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16786 - RNA, 1617 nt, Artificial Sequence
  derived and/or modified sequence opt2 from VP1__Norovirus_and/or_Norovirus-like__LC175468
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16787 - RNA, 1617 nt, Artificial Sequence
  derived and/or modified sequence opt2 from VP1__Norovirus_and/or_Norovirus-like__KX354137
augaagauggccuccuccgacgccaaccccuccgacggcuccgccgccaaccucguccccgaggucuccaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcuccgacggcuccacccgcggccacaaggccaccgucuacaccggcuccgccgacuucgcccccaagcucggccgcguccaguucgagaccgacaccgaccgcgacuucgagaccaaccagaacaccaaguucacccccgucggcgucauccaggacggcaccaccgcccaccgcaacgagccccagcaguggguccuccccuccuacuccggccgcaacauccacaacguccaccucgcccccgccgucgcccccaccuuccccggcgagcagcuccucuccuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16788 - RNA, 1617 nt, Artificial Sequence
  derived and/or modified sequence opt2 from VP1__Norovirus_and/or_Norovirus-like__KX354036
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcucccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16789 - RNA, 1617 nt, Artificial Sequence
  derived and/or modified sequence opt2 from VP1__Norovirus_and/or_Norovirus-like__KX354011
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16790 - RNA, 1617 nt, Artificial Sequence
  derived and/or modified sequence opt2 from VP1__Norovirus_and/or_Norovirus-like__LC153122
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgucucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16791 - RNA, 1617 nt, Artificial Sequence
  derived and/or modified sequence opt2 from VP1__Norovirus_and/or_Norovirus-like__KR131777
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacugguccuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16792 - RNA, 1617 nt, Artificial Sequence
  derived and/or modified sequence opt2 from VP1__Norovirus_and/or_Norovirus-like__AB933764
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16793 - RNA, 1617 nt, Artificial Sequence
  derived and/or modified sequence opt2 from VP1__Norovirus_and/or_Norovirus-like__LC016600
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcaccuccaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccggcgcccaccgcaacgagccccagcaguggguccuccccaacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16794 - RNA, 1617 nt, Artificial Sequence
  derived and/or modified sequence opt2 from VP1__Norovirus_and/or_Norovirus-like__KJ433970
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagucccgcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16795 - RNA, 1617 nt, Artificial Sequence
  derived and/or modified sequence opt2 from VP1__Norovirus_and/or_Norovirus-like__KP176395
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgucgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16796 - RNA, 1617 nt, Artificial Sequence
  derived and/or modified sequence opt2 from VP1__Norovirus_and/or_Norovirus-like__KM982947
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgccgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16797 - RNA, 1617 nt, Artificial Sequence
  derived and/or modified sequence opt2 from VP1__Norovirus_and/or_Norovirus-like__KJ685414
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16798 - RNA, 1617 nt, Artificial Sequence
  derived and/or modified sequence opt2 from VP1__Norovirus_and/or_Norovirus-like__KF060093
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcaacaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16799 - RNA, 1617 nt, Artificial Sequence
  derived and/or modified sequence opt2 from VP1__Norovirus_and/or_Norovirus-like__KC456070
augaagauggccuccuccgacgccaaccccuccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcgaguucaccgucucccccaagaacgcccccggcgagauccucugguccgccccccucggccccgaccucaaccccuaccucucccaccucgccaagauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaucggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16800 - RNA, 1617 nt, Artificial Sequence
  derived and/or modified sequence opt2 from VP1__Norovirus_and/or_Norovirus-like__KC409299
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16801 - RNA, 1617 nt, Artificial Sequence
  derived and/or modified sequence opt2 from VP1__Norovirus_and/or_Norovirus-like__JX984947
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccuccuccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaccugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucaacaccgacaccgagaacgacuucgagacccaccagaacaccaaguucacccccgucggcgucauccaggacggcggcaccacccaccgcaacgagccccagcaguggguccuccccuccuacuccggccgcaacauccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16802 - RNA, 1617 nt, Artificial Sequence
  derived and/or modified sequence opt2 from VP1__Norovirus_and/or_Norovirus-like__KC175385
augaagauggccuccuccgacgccaaccccuccaacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccuccucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuuccagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16803 - RNA, 1617 nt, Artificial Sequence
  derived and/or modified sequence opt2 from VP1__Norovirus_and/or_Norovirus-like__JQ613563
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacacccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16804 - RNA, 1617 nt, Artificial Sequence
  derived and/or modified sequence opt2 from VP1__Norovirus_and/or_Norovirus-like__JQ613558
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaucggccaguacgaccucgucaucccccccaacggcuacuuccgcuucgacuccugggucaaccaguucuacacccucgcccccaugggcaacggcaccggccgccgccgcuga

SEQ ID NO: 16805 - RNA, 1617 nt, Artificial Sequence
  derived and/or modified sequence opt2 from VP1__Norovirus_and/or_Norovirus-like__GQ856451
augaagauggccuccaacgacgccaaccccuccgacggcuccgucgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgacuccaccaucaagcucaucgccaugcucuacaccccccuccgcgccgacaacgccggcgaggacgucuucaccgucuccugccgcguccucacccgccccucccccgacuucgacuucaucuuccucgucccccccaccgucgaguccaagaccaagcccuucaccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacucccgcuucgacuccugggucaaccaguucuacacccucgcccccaugggcaacggcaccggccgccgccgcuga

SEQ ID NO: 16806 - RNA, 1617 nt, Artificial Sequence
  derived and/or modified sequence opt2 from VP1__Norovirus_and/or_Norovirus-like__DQ419908
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucgacuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16807 - RNA, 1617 nt, Artificial Sequence
  derived and/or modified sequence opt2 from VP1__Norovirus_and/or_Norovirus-like__KX514354
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccguccaggagaugaccaacucccgcuuccccgccacccucgacaagcucuucaccggccccuccuccacccucgucguccagccccagaacggccgcugcaugaucgacggcguccuccucggcaccacccagcucucccccgucaacaucugcaccuuccgcggcgacgucacccacucccgcgacuccaccaucuacaccaugaaccucgccucccccaacuggaacaacuacgaccccaccgaggagauccccgccccccucggcacccccgacuucgucggcaagauccagggcguccucacccagaccaccaagggcgagggcuccacccgcggccaccgcgccaccgucuacgucggcuccgccaacuacacccccaagcucggcaagguccaguucgagaccaacaccaccaacgaccucuacgcccaccagaacacccgcuucacccccgucggcgucguccagggcggcgaguccgcccaccgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16808 - RNA, 1617 nt, Artificial Sequence
  derived and/or modified sequence opt2 from VP1__Norovirus_and/or_Norovirus-like__KX354062
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccaacucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16809 - RNA, 1617 nt, Artificial Sequence
  derived and/or modified sequence opt2 from VP1__Norovirus_and/or_Norovirus-like__AB972532
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16810 - RNA, 1617 nt, Artificial Sequence
  derived and/or modified sequence opt2 from VP1__Norovirus_and/or_Norovirus-like__KT202796
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggacgccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16811 - RNA, 1617 nt, Artificial Sequence
  derived and/or modified sequence opt2 from VP1__Norovirus_and/or_Norovirus-like__AB933751
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaacaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16812 - RNA, 1617 nt, Artificial Sequence
  derived and/or modified sequence opt2 from VP1__Norovirus_and/or_Norovirus-like__KM514078
augaagauggccuccuccgacgccaaccccuccgacggcuccgccgccaaccucguccccgaggucaacaacgagguccucgcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16813 - RNA, 1617 nt, Artificial Sequence
  derived and/or modified sequence opt2 from VP1__Norovirus_and/or_Norovirus-like__KM198569
augaagauggccuccaacgacgccaaccccuccgacggcuccgccgccaaccucguccccgaggucuccaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16814 - RNA, 1617 nt, Artificial Sequence
  derived and/or modified sequence opt2 from VP1__Norovirus_and/or_Norovirus-like__KF768522
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16815 - RNA, 1617 nt, Artificial Sequence
  derived and/or modified sequence opt2 from VP1__Norovirus_and/or_Norovirus-like__KF060120
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggaacgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggcaagugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16816 - RNA, 1617 nt, Artificial Sequence
  derived and/or modified sequence opt2 from VP1__Norovirus_and/or_Norovirus-like__KF060102
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16817 - RNA, 1617 nt, Artificial Sequence
  derived and/or modified sequence opt2 from VP1__Norovirus_and/or_Norovirus-like__KF060088
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16818 - RNA, 1617 nt, Artificial Sequence
  derived and/or modified sequence opt2 from VP1__Norovirus_and/or_Norovirus-like__KF060025
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucgccgaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16819 - RNA, 1617 nt, Artificial Sequence
  derived and/or modified sequence opt2 from VP1__Norovirus_and/or_Norovirus-like__KC517378
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacgucggcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16820 - RNA, 1617 nt, Artificial Sequence
  derived and/or modified sequence opt2 from VP1__Norovirus_and/or_Norovirus-like__JX459640
augaagauggccuccuccgacgccaaccccuccgacggcuccaccgcccaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16821 - RNA, 1617 nt, Artificial Sequence
  derived and/or modified sequence opt2 from VP1__Norovirus_and/or_Norovirus-like__JQ613512
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacgccugggucaaccaguucuacacccucgcccccaugggcaacggcaccggccgcaagcgcuga

SEQ ID NO: 16822 - RNA, 1617 nt, Artificial Sequence
  derived and/or modified sequence opt2 from VP1__Norovirus_and/or_Norovirus-like__HQ005299
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16823 - RNA, 1617 nt, Artificial Sequence
  derived and/or modified sequence opt2 from VP1__Norovirus_and/or_Norovirus-like__AB541312
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacugcauccucgaccucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16824 - RNA, 1617 nt, Artificial Sequence
  derived and/or modified sequence opt2 from VP1__Norovirus_and/or_Norovirus-like__AB541275
augaagauggccuccuccgacgccaacccccccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcuccuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuuccagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16825 - RNA, 1617 nt, Artificial Sequence
  derived and/or modified sequence opt2 from VP1__Norovirus_and/or_Norovirus-like__AB303930
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaaccucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccggcgaggagaugaccaacucccgcuuccccaucccccucgagaagcucuucaccggccccuccggcgccuucgucguccagccccagaacggccgcugcaccaccgacggcguccuccucggcaccacccagcuccuccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16826 - RNA, 1617 nt, Artificial Sequence
  derived and/or modified sequence opt2 from VP1__Norovirus_and/or_Norovirus-like__AY485642
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucccccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacggccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16827 - RNA, 1617 nt, Artificial Sequence
  derived and/or modified sequence opt2 from VP1__Norovirus_and/or_Norovirus-like__KX514343
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcaccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaguccggcaacaccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccaguccggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 16828 - RNA, 1617 nt, Artificial Sequence
  derived and/or modified sequence opt2 from VP1__Norovirus_and/or_Norovirus-like__KX514274
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgucacccucgacaagcucuucaccggccccuccuccaccaucgucguccagccccagaacggccgcugcaccaucgacggcguccuccucggcaccacccagcucucccccgucaacaucugcaccuuccgcggcgacgucacccacccccgcgacuccaccaucuacaccaugaaccucgccucccccaacuggaacaccuacgaccccaccgaggagauccccgccccccucggcacccccgacuucgucggcaagauccagggcaugcucacccagaccaccaagggcgccggcuccacccgcggccaccgcgccaccgucuacgucggcuccgccaacuacgcccccaagcucggccgcguccaguucgagaccaacaccuccgacgaccucgacgcccaccagaacaccaaguucacccccgucggcgucauccagggcggcgaguccgcccaccgcuccgagccccagcaguggguccuccccuccuacuccggccgcgacauccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16829 - RNA, 1617 nt, Artificial Sequence
  derived and/or modified sequence opt2 from VP1__Norovirus_and/or_Norovirus-like__KX514175
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16830 - RNA, 1617 nt, Artificial Sequence
  derived and/or modified sequence opt2 from VP1__Norovirus_and/or_Norovirus-like__KX354093
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacugguccuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16831 - RNA, 1617 nt, Artificial Sequence
  derived and/or modified sequence opt2 from VP1__Norovirus_and/or_Norovirus-like__KX354003
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16832 - RNA, 1617 nt, Artificial Sequence
  derived and/or modified sequence opt2 from VP1__Norovirus_and/or_Norovirus-like__KR131778
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccgaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16833 - RNA, 1617 nt, Artificial Sequence
  derived and/or modified sequence opt2 from VP1__Norovirus_and/or_Norovirus-like__AB972468
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucguccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16834 - RNA, 1617 nt, Artificial Sequence
  derived and/or modified sequence opt2 from VP1__Norovirus_and/or_Norovirus-like__KR904222
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacugcgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16835 - RNA, 1617 nt, Artificial Sequence
  derived and/or modified sequence opt2 from VP1__Norovirus_and/or_Norovirus-like__KP244320
augaagauggccuccuccgacgccaaccccuccgacggcuccaccgccaaccucguccccgaggucaacaacgaggucauggcccucgagcccgucgucggcgccuccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucccccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacuaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagucccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16836 - RNA, 1617 nt, Artificial Sequence
  derived and/or modified sequence opt2 from VP1__Norovirus_and/or_Norovirus-like__KP244315
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgucguccaggucauccucgccggcaacgccuucaccgccggcaagaucaucuucgccgccgucccccccaacuuccccaccgagggccucucccccucccaggucaccauguucccccacaucaucgucgacgcccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccaccaagaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16837 - RNA, 1617 nt, Artificial Sequence
  derived and/or modified sequence opt2 from VP1__Norovirus_and/or_Norovirus-like__KP244314
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgucggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuuccaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcauccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16838 - RNA, 1617 nt, Artificial Sequence
  derived and/or modified sequence opt2 from VP1__Norovirus_and/or_Norovirus-like__KM268078
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16839 - RNA, 1617 nt, Artificial Sequence
  derived and/or modified sequence opt2 from VP1__Norovirus_and/or_Norovirus-like__KM198555
augaagauggccuccuccgacgccaaccccuccgacggcuccaccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccaguccuggaacuccuacgaccccaccgaggagauccccgccccccucggcucccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16840 - RNA, 1617 nt, Artificial Sequence
  derived and/or modified sequence opt2 from VP1__Norovirus_and/or_Norovirus-like__KF060115
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16841 - RNA, 1617 nt, Artificial Sequence
  derived and/or modified sequence opt2 from VP1__Norovirus_and/or_Norovirus-like__KF060018
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16842 - RNA, 1617 nt, Artificial Sequence
  derived and/or modified sequence opt2 from VP1__Norovirus_and/or_Norovirus-like__KC517365
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucgacaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacgcccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgccgcccacaccggccagcacgaccucgucaucccccccaacggcuacuuccgcuucgacuccugggucaaccaguucuacacccucgcccccaugggcaacggcaccggccgccgccgcuga

SEQ ID NO: 16843 - RNA, 1617 nt, Artificial Sequence
  derived and/or modified sequence opt2 from VP1__Norovirus_and/or_Norovirus-like__KC517360
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccgccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcugccccgacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucaucaucccccccaacggcuacuuccgcuucgacuccugggucaaccaguucuacacccucgcccccaugggcaacggcaccggccgccgccgcuga

SEQ ID NO: 16844 - RNA, 1617 nt, Artificial Sequence
  derived and/or modified sequence opt2 from VP1__Norovirus_and/or_Norovirus-like__JX846928
augaagauggccuccuccgacgccucccccuccgacggcuccaccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcaacaccaccccccgcaacgagccccagcaguggguccuccccuccuacuccggccgcaacauccagaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16845 - RNA, 1617 nt, Artificial Sequence
  derived and/or modified sequence opt2 from VP1__Norovirus_and/or_Norovirus-like__JX459904
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16846 - RNA, 1617 nt, Artificial Sequence
  derived and/or modified sequence opt2 from VP1__Norovirus_and/or_Norovirus-like__JX459649
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuucuccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16847 - RNA, 1617 nt, Artificial Sequence
  derived and/or modified sequence opt2 from VP1__Norovirus_and/or_Norovirus-like__JX459643
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcgucgaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16848 - RNA, 1617 nt, Artificial Sequence
  derived and/or modified sequence opt2 from VP1__Norovirus_and/or_Norovirus-like__JX459602
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccucgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagacccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16849 - RNA, 1617 nt, Artificial Sequence
  derived and/or modified sequence opt2 from VP1__Norovirus_and/or_Norovirus-like__LC177655
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggcgcgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccccccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16850 - RNA, 1617 nt, Artificial Sequence
  derived and/or modified sequence opt2 from VP1__Norovirus_and/or_Norovirus-like__KP784698
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucacccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16851 - RNA, 1617 nt, Artificial Sequence
  derived and/or modified sequence opt2 from VP1__Norovirus_and/or_Norovirus-like__KX354104
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16852 - RNA, 1617 nt, Artificial Sequence
  derived and/or modified sequence opt2 from VP1__Norovirus_and/or_Norovirus-like__KR904211
augaagauggccuccuccgacgccaaccccuccgacggcuccaccgccaaccucguccccgaggucaacaacgaggucauggcccucgagcccgucgucggcgccgccaucgccgcccccgucgccggccagcagaacgccaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16853 - RNA, 1617 nt, Artificial Sequence
  derived and/or modified sequence opt2 from VP1__Norovirus_and/or_Norovirus-like__AB933743
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcuccauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16854 - RNA, 1617 nt, Artificial Sequence
  derived and/or modified sequence opt2 from VP1__Norovirus_and/or_Norovirus-like__LN854572
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16855 - RNA, 1617 nt, Artificial Sequence
  derived and/or modified sequence opt2 from VP1__Norovirus_and/or_Norovirus-like__KP244319
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccgucuccaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcgccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16856 - RNA, 1617 nt, Artificial Sequence
  derived and/or modified sequence opt2 from VP1__Norovirus_and/or_Norovirus-like__KF768470
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucuccaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16857 - RNA, 1617 nt, Artificial Sequence
  derived and/or modified sequence opt2 from VP1__Norovirus_and/or_Norovirus-like__KC456073
augaagauggccuccuccgacgccaaccccuccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcgaguucaccgucucccccaagaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16858 - RNA, 1617 nt, Artificial Sequence
  derived and/or modified sequence opt2 from VP1__Norovirus_and/or_Norovirus-like__KC456072
augaagauggccuccuccgacgccaaccccuccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcgaguucaccgucucccccaagaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16859 - RNA, 1617 nt, Artificial Sequence
  derived and/or modified sequence opt2 from VP1__Norovirus_and/or_Norovirus-like__JX459622
augaagauggccuccaacgacgcccaccccuccgacggcuccgccgccacccucguccccaaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagcuccacguccuccucgccggcaacgccuucaccgccggcaagaucaucaucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaucuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16860 - RNA, 1617 nt, Artificial Sequence
  derived and/or modified sequence opt2 from VP1__Norovirus_and/or_Norovirus-like__KX514290
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccgacuucacccccaagcucggcaagguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16861 - RNA, 1617 nt, Artificial Sequence
  derived and/or modified sequence opt2 from VP1__Norovirus_and/or_Norovirus-like__KP784695
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcaacaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16862 - RNA, 1617 nt, Artificial Sequence
  derived and/or modified sequence opt2 from VP1__Norovirus_and/or_Norovirus-like__KX608865
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16863 - RNA, 1617 nt, Artificial Sequence
  derived and/or modified sequence opt2 from VP1__Norovirus_and/or_Norovirus-like__AB972500
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16864 - RNA, 1617 nt, Artificial Sequence
  derived and/or modified sequence opt2 from VP1__Norovirus_and/or_Norovirus-like__KT033902
augaagauggccuccuccgacgccaaccccuccgacggcuccaccgccaaccucauccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacaucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16865 - RNA, 1617 nt, Artificial Sequence
  derived and/or modified sequence opt2 from VP1__Norovirus_and/or_Norovirus-like__KR904220
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgucggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccaccgacuucacccccaagcucggccgcgcccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16866 - RNA, 1617 nt, Artificial Sequence
  derived and/or modified sequence opt2 from VP1__Norovirus_and/or_Norovirus-like__LN854566
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucucccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16867 - RNA, 1617 nt, Artificial Sequence
  derived and/or modified sequence opt2 from VP1__Norovirus_and/or_Norovirus-like__KP244313
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccaggccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16868 - RNA, 1617 nt, Artificial Sequence
  derived and/or modified sequence opt2 from VP1__Norovirus_and/or_Norovirus-like__KP096342
augaagauggccuccuccgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16869 - RNA, 1617 nt, Artificial Sequence
  derived and/or modified sequence opt2 from VP1__Norovirus_and/or_Norovirus-like__KM514067
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccccgaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16870 - RNA, 1617 nt, Artificial Sequence
  derived and/or modified sequence opt2 from VP1__Norovirus_and/or_Norovirus-like__KF060049
augaagauggccuccuccgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16871 - RNA, 1617 nt, Artificial Sequence
  derived and/or modified sequence opt2 from VP1__Norovirus_and/or_Norovirus-like__KF059998
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccgccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcaacaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16872 - RNA, 1617 nt, Artificial Sequence
  derived and/or modified sequence opt2 from VP1__Norovirus_and/or_Norovirus-like__JX439833
augaagauggccuccuccgacgccaaccccuccgacggcuccaaggccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggcucccgccgcuga

SEQ ID NO: 16873 - RNA, 1617 nt, Artificial Sequence
  derived and/or modified sequence opt2 from VP1__Norovirus_and/or_Norovirus-like__JQ613548
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccgccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16874 - RNA, 1617 nt, Artificial Sequence
  derived and/or modified sequence opt2 from VP1__Norovirus_and/or_Norovirus-like__JN595867
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagacccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16875 - RNA, 1617 nt, Artificial Sequence
  derived and/or modified sequence opt2 from VP1__Norovirus_and/or_Norovirus-like__AB629944
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccuccuacgucaccgucgcccacaccggccagcacgaccucgucaucccccccaacggcuacuuccgcuucgacuccugggucaaccaguucuacacccucgcccccaugggcaacggcaccggccgccgccacuga

SEQ ID NO: 16876 - RNA, 1617 nt, Artificial Sequence
  derived and/or modified sequence opt2 from VP1__Norovirus_and/or_Norovirus-like__AB541192
augaagauggccuccuccgacgccaacccccccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgccacccacaucgccggcucccgcuccuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuuccagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16877 - RNA, 1617 nt, Artificial Sequence
  derived and/or modified sequence opt2 from VP1__Norovirus_and/or_Norovirus-like__AB504314
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggccgcauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccuccgcaacgagccccagcaguggguccuccccgacuacuccggccgcaccguccacaacguccaccucgcccccgccgucgcccucaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccaccgcgccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16878 - RNA, 1617 nt, Artificial Sequence
  derived and/or modified sequence opt2 from VP1__Norovirus_and/or_Norovirus-like__KX514350
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaguccggcaacaccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccaguccggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16879 - RNA, 1617 nt, Artificial Sequence
  derived and/or modified sequence opt2 from VP1__Norovirus_and/or_Norovirus-like__KX514342
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaguccggcaacaccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccaguccggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16880 - RNA, 1617 nt, Artificial Sequence
  derived and/or modified sequence opt2 from VP1__Norovirus_and/or_Norovirus-like__KX514280
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgucacccucgacaagcucuucaccggccccuccuccaccaucgucguccagccccagaacggccgcugcaccaucgacggcguccuccucggcaccacccagcucucccccgucaacaucugcaccuuccgcggcgacgucacccacccccgcgacuccaccaucuacaccaugaaccucgccucccccaacuggaacaccuacgaccccaccgaggagauccccgccccccucggcacccccgacuucgucggcaagauccagggcaugcucacccagaccaccaagggcgccggcuccacccgcggccaccgcgccaccgucuacgucggcuccgccaacuacgcccccaagcucggccgcguccaguucgagaccaacaccuccgacgaccucgacgcccaccagaacaccaaguucacccccgucggcgucauccagggcggcgaguccgcccaccgcuccgagccccagcaguggguccuccccuccuacuccggccgcgacauccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16881 - RNA, 1617 nt, Artificial Sequence
  derived and/or modified sequence opt2 from VP1__Norovirus_and/or_Norovirus-like__LC177654
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16882 - RNA, 1617 nt, Artificial Sequence
  derived and/or modified sequence opt2 from VP1__Norovirus_and/or_Norovirus-like__KX354026
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16883 - RNA, 1617 nt, Artificial Sequence
  derived and/or modified sequence opt2 from VP1__Norovirus_and/or_Norovirus-like__KR904218
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccgcaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcuccaccgacggcguccuccucggcaccacccagcucucccccgucaacaucugcaccuuccgcggcgacgucacccacaucgccggcucccacaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccaacaacgacuucgaguccaaccagaacaccaaguucgcccccgucggcgucauccaggacggcggcaccgcccaccgcaacgagccccagcaguggguccuccccuccuacuccggccgcaacauccacaacguccaccucgcccccgccgucgcccccaccuuccccggcgagcagcuccucuucuuccgcuccaccauccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16884 - RNA, 1617 nt, Artificial Sequence
  derived and/or modified sequence opt2 from VP1__Norovirus_and/or_Norovirus-like__KJ678150
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16885 - RNA, 1617 nt, Artificial Sequence
  derived and/or modified sequence opt2 from VP1__Norovirus_and/or_Norovirus-like__KJ678148
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccauccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16886 - RNA, 1617 nt, Artificial Sequence
  derived and/or modified sequence opt2 from VP1__Norovirus_and/or_Norovirus-like__KP244316
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagacccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcgacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgaccgccuccucccccaggaguggguccaguacuucuaccaggagcccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16887 - RNA, 1617 nt, Artificial Sequence
  derived and/or modified sequence opt2 from VP1__Norovirus_and/or_Norovirus-like__KF060072
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucaucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16888 - RNA, 1617 nt, Artificial Sequence
  derived and/or modified sequence opt2 from VP1__Norovirus_and/or_Norovirus-like__JX439822
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggcucccgccgcuga

SEQ ID NO: 16889 - RNA, 1617 nt, Artificial Sequence
  derived and/or modified sequence opt2 from VP1__Norovirus_and/or_Norovirus-like__KC463910
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucuccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16890 - RNA, 1617 nt, Artificial Sequence
  derived and/or modified sequence opt2 from VP1__Norovirus_and/or_Norovirus-like__JX459651
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuucuccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16891 - RNA, 1617 nt, Artificial Sequence
  derived and/or modified sequence opt2 from VP1__Norovirus_and/or_Norovirus-like__AB541314
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggucgucuucaccgucuccugccgcguccucacccgccccucccccgacuucgacuucaucugccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucauccccuccaacggcuacuuccgcuucgacuccugggucaaccaguucuacacccucgcccccaugggcaacggcaccggccgccgccgcuga

SEQ ID NO: 16892 - RNA, 1617 nt, Artificial Sequence
  derived and/or modified sequence opt2 from VP1__Norovirus_and/or_Norovirus-like__AB504323
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucaucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccucgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcacccuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16893 - RNA, 1617 nt, Artificial Sequence
  derived and/or modified sequence opt2 from VP1__Norovirus_and/or_Norovirus-like__KX353963
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccaggacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16894 - RNA, 1617 nt, Artificial Sequence
  derived and/or modified sequence opt2 from VP1__Norovirus_and/or_Norovirus-like__KR904213
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuucucccucgcccccaugggcaacggcaccggccgccgccgcuga

SEQ ID NO: 16895 - RNA, 1617 nt, Artificial Sequence
  derived and/or modified sequence opt2 from VP1__Norovirus_and/or_Norovirus-like__AB933745
augaagauggccuccaaccacgucaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaucaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16896 - RNA, 1617 nt, Artificial Sequence
  derived and/or modified sequence opt2 from VP1__Norovirus_and/or_Norovirus-like__KP096341
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaucggcggcgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16897 - RNA, 1617 nt, Artificial Sequence
  derived and/or modified sequence opt2 from VP1__Norovirus_and/or_Norovirus-like__KM114291
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccccgcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcgccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16898 - RNA, 1617 nt, Artificial Sequence
  derived and/or modified sequence opt2 from VP1__Norovirus_and/or_Norovirus-like__KF060105
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacgucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16899 - RNA, 1617 nt, Artificial Sequence
  derived and/or modified sequence opt2 from VP1__Norovirus_and/or_Norovirus-like__KF060081
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16900 - RNA, 1617 nt, Artificial Sequence
  derived and/or modified sequence opt2 from VP1__Norovirus_and/or_Norovirus-like__KF059999
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggagaccgcccccgcccaguccgacgucgcccuccuccgcuucgucaaccccgacaccggccgcguccucuucgagugcaagcuccacaaguccugcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16901 - RNA, 1617 nt, Artificial Sequence
  derived and/or modified sequence opt2 from VP1__Norovirus_and/or_Norovirus-like__JX644036
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16902 - RNA, 1617 nt, Artificial Sequence
  derived and/or modified sequence opt2 from VP1__Norovirus_and/or_Norovirus-like__JX459654
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccucgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16903 - RNA, 1617 nt, Artificial Sequence
  derived and/or modified sequence opt2 from VP1__Norovirus_and/or_Norovirus-like__JN400621
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcgucauguucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16904 - RNA, 1617 nt, Artificial Sequence
  derived and/or modified sequence opt2 from VP1__Norovirus_and/or_Norovirus-like__AB541260
augaagauggccuccaacgacgccaaccccuccgacggcuccgccgccaaccucguccccgaggucaacaacgaggucauggcccucgagcccgucgucggcgccgccaucgccgcccccgucgccgcccagcagaacgucaucgaccccuggauccgcaacaacuucguccaggcccccggcggcgaguucaccgucuccccccgcaacgcccccuccgagauccucugguccgccccccucggccccgaccucaaccccuaccucucccacuucgcccgcauguacaacugcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16905 - RNA, 1617 nt, Artificial Sequence
  derived and/or modified sequence opt2 from VP1__Norovirus_and/or_Norovirus-like__KX514341
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaguccggcaacaccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccaguccggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16906 - RNA, 1617 nt, Artificial Sequence
  derived and/or modified sequence opt2 from VP1__Norovirus_and/or_Norovirus-like__KX514253
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccggccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucaaccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccguccaggagaugaccaacucccgcuuccccgccacccucgacaagcucuucaccggccccuccuccaaccucgucguccagccccagaacggccgcugcaugaucgacggcguccuccucggcaccacccagcucucccccgucaacaucugcaccuuccgcggcgacgucacccaccuccgcgacuccaccaucuacaccaugaaccucgccucccccaacuggaacaacuacgaccccaccgaggagauccccgccccccucggcacccccgacuucgucggcaagauccagggcguccucacccagaccaccaagggcgagggcuccacccgcggccaccgcgccaccgucuacgucggcuccgccgacuacacccccaagcucggcaagguccaguucgagaccaacaccaccaacgaccucuacgcccaccagaacaccaaguucacccccgucggcgucguccagggcggcgaguccgcccaccgcuccgagccccagcaguggguccuccccggcuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16907 - RNA, 1617 nt, Artificial Sequence
  derived and/or modified sequence opt2 from VP1__Norovirus_and/or_Norovirus-like__KX514195
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccacccucgucguccagccccagaacggccgcugcaugaucgacggcguccuccucggcaccacccagcucucccccgucaacaucugcaccuuccgcggcgacgucacccacucccgcgacuccaccaucuacaccaugaaccucgccucccccaacuggaacaacuacgaccccaccgaggagauccccgccccccucggcacccccgacuucgucggcaagauccagggcguccucacccagaccaccaagggcgagggcuccacccgcggccaccgcgccaccgucuacgucggcuccgccaacuacacccccaagcucggcaagguccaguucgagaccaacaccaccaacgaccucuacgcccaccagaacacccgcuucacccccgucggcgucguccagggcggcgaguccgcccaccgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16908 - RNA, 1617 nt, Artificial Sequence
  derived and/or modified sequence opt2 from VP1__Norovirus_and/or_Norovirus-like__KX354016
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcggcgucacccacauccccggcucccacaacuacaccaugaaccucgccucccagaacugguccuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16909 - RNA, 1617 nt, Artificial Sequence
  derived and/or modified sequence opt2 from VP1__Norovirus_and/or_Norovirus-like__KM245073
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccaccucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16910 - RNA, 1617 nt, Artificial Sequence
  derived and/or modified sequence opt2 from VP1__Norovirus_and/or_Norovirus-like__LN854567
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgacuucgucguccagccccagaacggccgcugcaccaccgacggcguccuccucggcaccacccagcucucccccgucaacaucugcaccuuccgcggcgacgucacccacaccaccggcucccgcaacuacaccaugaaccucgccucccagaacuggaacaacuacgaccccaccgaggagacccccgccccccucggcacccccgacuucgucggcaagauccgcggcaugcucacccagaccacccgcgccgacggcuccacccgcggccacaaggccaccgucuacaccggcuccgccgacuucgcccccaagcucggccgcguccaguucgagaccgacaccgacaacgacuucgacgccaaccagaacaccaaguucacccccgucggcgucauccaggacggcaccaccacccaccgcaacgagccccgccaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguucuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 16911 - RNA, 1617 nt, Artificial Sequence
  derived and/or modified sequence opt2 from VP1__Norovirus_and/or_Norovirus-like__JN400619
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccugcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16912 - RNA, 1617 nt, Artificial Sequence
  derived and/or modified sequence opt2 from VP1__Norovirus_and/or_Norovirus-like__KF060052
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgucaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16913 - RNA, 1617 nt, Artificial Sequence
  derived and/or modified sequence opt2 from VP1__Norovirus_and/or_Norovirus-like__KF060014
augaagauggccuccuccgacgccaaccccuccgacggcuccaccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacuccgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16914 - RNA, 1617 nt, Artificial Sequence
  derived and/or modified sequence opt2 from VP1__Norovirus_and/or_Norovirus-like__KC517375
augaagauggccuccuccgacgccaaccccuccgacggcuccgccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacgccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16915 - RNA, 1617 nt, Artificial Sequence
  derived and/or modified sequence opt2 from VP1__Norovirus_and/or_Norovirus-like__JX644039
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaccuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16916 - RNA, 1617 nt, Artificial Sequence
  derived and/or modified sequence opt2 from VP1__Norovirus_and/or_Norovirus-like__JX644031
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacugguccuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16917 - RNA, 1617 nt, Artificial Sequence
  derived and/or modified sequence opt2 from VP1__Norovirus_and/or_Norovirus-like__HM191773
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgccgagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16918 - RNA, 1617 nt, Artificial Sequence
  derived and/or modified sequence opt2 from VP1__Norovirus_and/or_Norovirus-like__AB504309
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuucaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16919 - RNA, 1617 nt, Artificial Sequence
  derived and/or modified sequence opt2 from VP1__Norovirus_and/or_Norovirus-like__KX514216
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaccuccgcgacucccccaucuacaccaugaaccucgccucccccaacuggaacaacuacgacuccaccgaggagauccccgccccccucggcacccccgacuucgucggcaagauccagggcguccucacccagaccaccaagggcgagggcuccacccgcggccaccgcgccaccgucuacgucggcuccgccaacuacacccccaagcucggcaagguccaguucgagaccaacaccaccaacgaccucuacgcccaccagaacaccaaguucacccccgucggcgucguccagggcggcgaguccgcccaccgcuccgagccccagcaguggguccuccccggcuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16920 - RNA, 1617 nt, Artificial Sequence
  derived and/or modified sequence opt2 from VP1__Norovirus_and/or_Norovirus-like__KX514212
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgagcucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccguccaggagaugaccaacucccgcuuccccgccacccucgacaagcucuucaccggccccuccuccaaccucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcguccucacccagaccaccaagggcgagggcuccacccgcggccaccgcgccaccgucuacgucggcuccgccaacuacacccccaagcucggcaagguccaguucgagaccaacaccaccaacgaccucuacgcccaccagaacaccaaguucacccccgucggcgucguccagggcggcgaguccgcccaccgcuccgagccccagcaguggguccuccccggcuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16921 - RNA, 1617 nt, Artificial Sequence
  derived and/or modified sequence opt2 from VP1__Norovirus_and/or_Norovirus-like__KX354138
augaagauggccuccuccgacgccaaccccuccgacggcuccgccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgccggccucucccccucccaggucaccauguuccccuccaucgucgucgacguccgccagcucgagcccguccucaucccccuccccgacguccgcaacaacuucuaccacuacaaccaguccaacgaccccaccaucacccucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacaucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgccgacuucucccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16922 - RNA, 1617 nt, Artificial Sequence
  derived and/or modified sequence opt2 from VP1__Norovirus_and/or_Norovirus-like__AB933747
augaagauggccuccuccgacgccaaccccuucgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16923 - RNA, 1617 nt, Artificial Sequence
  derived and/or modified sequence opt2 from VP1__Norovirus_and/or_Norovirus-like__KJ955493
augaagauggccuccuccgacgccaaccccuccgacggcuccgccgccaaccucguccccgaggucaacaacgaggucauggcccucgagcccuucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccucaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcuccgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16924 - RNA, 1617 nt, Artificial Sequence
  derived and/or modified sequence opt2 from VP1__Norovirus_and/or_Norovirus-like__KJ678153
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccacccuccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16925 - RNA, 1617 nt, Artificial Sequence
  derived and/or modified sequence opt2 from VP1__Norovirus_and/or_Norovirus-like__KC456071
augaagauggccuccuccgacgccaacccccccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcgaguucaccgucucccccaagaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcgacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16926 - RNA, 1617 nt, Artificial Sequence
  derived and/or modified sequence opt2 from VP1__Norovirus_and/or_Norovirus-like__KC175384
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacugggacuccuacgaccccaccgaggagacccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16927 - RNA, 1617 nt, Artificial Sequence
  derived and/or modified sequence opt2 from VP1__Norovirus_and/or_Norovirus-like__JQ613561
augaagauggccuccuccgacgccaaccccuccgacggcuccaccgccaaccucguccccgaggucaacaccgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgccgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16928 - RNA, 1617 nt, Artificial Sequence
  derived and/or modified sequence opt2 from VP1__Norovirus_and/or_Norovirus-like__KJ678145
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgaguccugggucaaccaguucuacacccucgcccccaugggcaacggcaccggccgccgccgcuga

SEQ ID NO: 16929 - RNA, 1617 nt, Artificial Sequence
  derived and/or modified sequence opt2 from VP1__Norovirus_and/or_Norovirus-like__KF060116
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagacccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16930 - RNA, 1617 nt, Artificial Sequence
  derived and/or modified sequence opt2 from VP1__Norovirus_and/or_Norovirus-like__KC517362
augaagauggccuccuccgacgccaaccccuccgacggcuccgccgccaaccucguccccgaggucaacaacgaggucaucgcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucgcccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaaccuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16931 - RNA, 1617 nt, Artificial Sequence
  derived and/or modified sequence opt2 from VP1__Norovirus_and/or_Norovirus-like__JX644038
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacgucugcaccuuccgcggcgacgucacccacaucuccggcucccgcaacuacaccaugaaccucgccucccagaacuggaccuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16932 - RNA, 1617 nt, Artificial Sequence
  derived and/or modified sequence opt2 from VP1__Norovirus_and/or_Norovirus-like__AB504313
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccacccgcggcgacggccucacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucgaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16933 - RNA, 1617 nt, Artificial Sequence
  derived and/or modified sequence opt2 from VP1__Norovirus_and/or_Norovirus-like__KX514361
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggcaaggacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16934 - RNA, 1617 nt, Artificial Sequence
  derived and/or modified sequence opt2 from VP1__Norovirus_and/or_Norovirus-like__KX514336
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacuccggcaacuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16935 - RNA, 1617 nt, Artificial Sequence
  derived and/or modified sequence opt2 from VP1__Norovirus_and/or_Norovirus-like__KX514203
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcuccaagcccuucuccguccccguccucaccguccaggagaugaccaacucccgcuuccccgccacccucgacaagcucuucaccggccccuccuccacccucgucguccagccccagaacggccgcugcaugaucgacggcguccuccucggcaccacccagcucucccccgucaacaucugcaccuuccgcggcgacgucacccacucccgcgacuccaccaucuacaccaugaaccucgccucccccaacuggaacaacuacgaccccaccgaggagauccccgccccccucggcacccccgacuucgucggcaagauccagggcguccucacccagaccaccaagggcgagggcuccacccgcggccaccgcgccaccgucuacgucggcuccgccaacuacacccccaagcucggcaagguccaguucgagaccaacaccaccaacgaccucuacgcccaccagaacacccgcuucacccccgucggcgucguccagggcggcgaguccgcccaccgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16936 - RNA, 1617 nt, Artificial Sequence
  derived and/or modified sequence opt2 from VP1__Norovirus_and/or_Norovirus-like__KP784693
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgagggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 16937 - RNA, 1617 nt, Artificial Sequence
  derived and/or modified sequence opt2 from VP1__Norovirus_and/or_Norovirus-like__AB933734
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgaguccgagaccaagcccuucuucuuccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16938 - RNA, 1617 nt, Artificial Sequence
  derived and/or modified sequence opt2 from VP1__Norovirus_and/or_Norovirus-like__KF060041
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucggcguccaggucauccucgccggcaacgccuucaccgccggcaaggucaucuucgccgccgucccccccaacuuccccaccgagggccucucccccucccaggucaccauguucccccacaucgucgucaacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccucaccggccagcacgaccucgucaucccccccaacggcuacuuccgcuucgacuccugggucaaccaguucuacacccucgcccccaugggcaacggcaccggccgccgccgcuga

SEQ ID NO: 16939 - RNA, 1617 nt, Artificial Sequence
  derived and/or modified sequence opt2 from VP1__Norovirus_and/or_Norovirus-like__JX989074
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagacccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16940 - RNA, 1617 nt, Artificial Sequence
  derived and/or modified sequence opt2 from VP1__Norovirus_and/or_Norovirus-like__JN400624
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacgaccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacuccguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16941 - RNA, 1617 nt, Artificial Sequence
  derived and/or modified sequence opt2 from VP1__Norovirus_and/or_Norovirus-like__EU876894
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgacccccgcauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugcuggguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgcuccgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16942 - RNA, 1617 nt, Artificial Sequence
  derived and/or modified sequence opt2 from VP1__Norovirus_and/or_Norovirus-like__KX514173
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccgccacuggaccaugaaccucgccucccccaacuggaacaacuacgaccccaccgaggagacccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 16943 - RNA, 1617 nt, Artificial Sequence
  derived and/or modified sequence opt2 from VP1__Norovirus_and/or_Norovirus-like__KX353989
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauggucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16944 - RNA, 1617 nt, Artificial Sequence
  derived and/or modified sequence opt2 from VP1__Norovirus_and/or_Norovirus-like__KX353962
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacccccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccaggacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16945 - RNA, 1617 nt, Artificial Sequence
  derived and/or modified sequence opt2 from VP1__Norovirus_and/or_Norovirus-like__AB972515
augaagauggccuccuccgacgccaaccccuccgacggcuccaccgccaaccucguccccgaggucaacaacgaggucauggcccucgagcccgucaucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16946 - RNA, 1617 nt, Artificial Sequence
  derived and/or modified sequence opt2 from VP1__Norovirus_and/or_Norovirus-like__KT033904
augaagauggccuccaacgacgccaaccccuccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcaaguucaccgucucccccaagaacgcccccggcgagauccucugguccgccccccucggccccgaccucaaccccuaccucucccaccucgcccgcauguacaagggccacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16947 - RNA, 1617 nt, Artificial Sequence
  derived and/or modified sequence opt2 from VP1__Norovirus_and/or_Norovirus-like__KM982942
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacucccgcgucaaccaguucuacacccucgcccccaugggcaacggcaccggccgccgccgcuga

SEQ ID NO: 16948 - RNA, 1617 nt, Artificial Sequence
  derived and/or modified sequence opt2 from VP1__Norovirus_and/or_Norovirus-like__KJ685417
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16949 - RNA, 1617 nt, Artificial Sequence
  derived and/or modified sequence opt2 from VP1__Norovirus_and/or_Norovirus-like__KC907392
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcucccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucgcccacaucgccggcacccagaacuacaccaugaaccucgccucccagaacuggaacaacuacgaccccaccgaggagauccccgccccccucggcacccccaacuucgucggcaagauccagggcguccucacccagaccaccaagcgcgacggcuccacccgcggccgcaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccgcaacgagccccagcaguggguccuccccgacuacuccggccgcgacucccacaacguccaccucgcccccgccgucgcccccaccuuccccggcgagcagcuccucuucuuccgcuccuccaugcccggcugcuccggcuaccccaacauggaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacucccgcuucgacuccugggucaaccaguucuacacccucgcccccaugggcaacggcgccggccgccgccgcuga

SEQ ID NO: 16950 - RNA, 1617 nt, Artificial Sequence
  derived and/or modified sequence opt2 from VP1__Norovirus_and/or_Norovirus-like__KC517377
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacgccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccaacaccggccgcguccucuucgagugcaagcuccacaaguccggcuacgucaccgucgcccacaccggccagcacgaccucgucaucccccccaacgacuacuuccgcuucgacuccugggucaaccaguucuacacccucgcccccaugggcaacggcaccggccgccgccgcuga

SEQ ID NO: 16951 - RNA, 1617 nt, Artificial Sequence
  derived and/or modified sequence opt2 from VP1__Norovirus_and/or_Norovirus-like__KC517368
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucgcccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccgagaacgccuucaccgccggcaagaucaucuucgccgccgucccccccaacuuccccaccgagggccucucccccucccgcgucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaccaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacguccccaccgaggagauccccgccccccucggcacccccgacuucgucggcaagguccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16952 - RNA, 1617 nt, Artificial Sequence
  derived and/or modified sequence opt2 from VP1__Norovirus_and/or_Norovirus-like__AB541310
augaagaugcgcuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccggcuccugccgcguccucacccgccccucccccgacuucgacuucaucuuccucgucccccccaccgucgagucccgcaccaagcccuucuccgucuccuucuucaccggcgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16953 - RNA, 1617 nt, Artificial Sequence
  derived and/or modified sequence opt2 from VP1__Norovirus_and/or_Norovirus-like__EF535854
augaagauggccaccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgaggucgaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaucuccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccccuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguccuacacccucgcccccaugggcaacggcgccggccgccgccgcuga

SEQ ID NO: 16954 - RNA, 1617 nt, Artificial Sequence
  derived and/or modified sequence opt2 from VP1__Norovirus_and/or_Norovirus-like__KX514368
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaccccggcaacuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga
